United States Patent 11,098,302 (IDENTIFICATION OF POLYNUCLEOTIDES ASSOCIATED WITH A SAMPLE) - sequence listing, part 126

SEQ ID NO: 437352 - DNA, 688 bp, Homo sapiens
  misc_feature: GZ8MTXP01AP0MP.13.38.D05.1.454.CMB.2.raw
  modified_base (198)..(198): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcgganacgagggtcaccatcacttgtcggcaagtcagaactattggacaactctttaaatggtatcagcagaagtcagggcaacgccccgaactcctgactctacggtacactcctactttgacacgtagtcgggactcccataccgaaggttcagtggactaaagtagaactcgtacgggaaactacgttacttttaccccactaaccctacgtacgtaacgggggttacctaaccgtacgtacccgttaagggtaaacgttacgtttttacggacgttaacctttaacgttaacgtttacgtaaccgtaaactaacggttaaccgtttaaccccgtttaccccgtaccccccgggtacggttacccgggaacccgtaaacggggtaaccggtaaacgggtaacggaaacgttaacgaacgacgggtaaacgttggtacggtcttacggccttaccgtaactcgtcgttctcgttacttccgttccccgtaacc

SEQ ID NO: 437353 - DNA, 677 bp, Homo sapiens
  misc_feature: GZ8MTXP01BGJRY.13.38.D05.1.454.CMB.2.raw
  modified_base (251)..(251): a, c, t, g, unknown or other
  modified_base (557)..(557): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccacggggacatcgtgatcgacccagtctccagacctccctggctgtgtctcgtgggcgaggacgggcccaccatcaaactgacaacgtccagccagtagttgttttaanacagtcctaccaaactaaataacgtaacttactagcttaggtaccagacaagaaaccaggaccagcctactaacgctacgtctactagtttacgcgggactacgttaccgttaacgttacccggggtaacgttcccccgggggtaccccctacgggtacccgtaagtttcccggaaggtcgggaccgtaacggggtccggggtacgtacggggacctacggtacctttccacctcctaccgaacctacgtacgacgacgtaacgtccgtggacgacgggtactaaggaaagtgtggggtacggttnttaacgtttattaccgtgtacagtactaaattattatacgtcctccgtacgagtcttacgtacggttcggacgggacggttacgaaggtacgaactagaccgaacgtaacgttgtaaccg

SEQ ID NO: 437354 - DNA, 704 bp, Homo sapiens
  misc_feature: GZ8MTXP01DWJAU.13.38.D05.1.454.CMB.2.raw
tcagtcacgtactacacgaccggtgctcgatttagtatctgatagttgggtttggggggagtcagtctcagtcaggacacagcatggacatgagggtccccgctcagctcctggggctcctgctactctggctccgaggtgccagatgtgacatccagatgagccagtctccactcccaccctgtctgcgtctctcggagacgagggtccaccatcacttggtcgggacaagtcagaacattggactaacttactttaaattggtatcagcagagtcgaggcaacgcccgaacctctgactctacgtacactcctatttcgacacgtagtacggactccctataccgtaaggttcaggtcggacgtaaagttaagtaacgttacgtacgggtaaacctaacgttaccttttaccccgacaaccctatccgtaaggggtcctaacgacggtacctaggtaaagtttacgtttacgacgttaacttaactagtttacgtaacaaacttacggttaaccgtttaccccgttccccgtacccccgggtaccgtttcccggaaacccggtaaacggggtaaacccgtaagggttaaacggaaacgtaacgaaacggttacggtaaaccgttgggtacggtacgttcggacccttacccgtaacttcgttcggttaccttccttaccttccccgttaacccggttaaccc

SEQ ID NO: 437355 - DNA, 773 bp, Homo sapiens
  misc_feature: GZ8MTXP01D3CRD.13.38.D05.1.454.CMB.2.raw
  modified_base (228)..(228): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacgagggtccaccatctacttggtcgganaagtcaagaactattggactaacttactttaaaagtggtatcgagacaagaacgtcgaagggaccaaaccggcccccgtaacctccgtagtactacgtaacggtactaactacctaccttacgttacgactaaggtggtaccggtacctaacccgtaagtaaccggttaaacggtcgtaggtaccggtaaacgttaaggtaacgtacgttaaaccgggtaaaccgtaaacgttaaccggtttttaacccctacccgtaaccctaacgtaacgttaaccgggggtacgttaaccaaccggtaaccgtaccggttaagttaacgttttacgttacggtaacctttaacttattacggttacgtaaacgtaaaccggttaaccgtttaaccccgtttacccgtaccccccggttacccggttaacggtaacccggtaaccggaaaccgggtaccggtaaaggaaccgtaaacgtacgaacgggtaaccgttagtacgggtcttaggcacctaacgtcttaacgttcttccttactccttaaccgtccc

SEQ ID NO: 437356 - DNA, 714 bp, Homo sapiens
  misc_feature: GZ8MTXP01BJCZE.13.38.D05.1.454.CMB.2.raw
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggcccaccatcaactgacaagtccagccagtagttgttttatacagcctaccaacaaataaagtaacttcttagcttggtaccagacaagaaaccaggaacacgaccctacctaagcctagctatagtttacgtgggctactctacgtccgggaaacgtcccggggtaccccctaggaccgtagttcgaggttcgggacaacggggtccgggtcgtaggggtaacctagtacgtttacaccttaccctaccaacctactacgaacggaccaacggtccccgtaggccggtaacggccgttaaggaaagtagttgggggttacggtacgtttaagttttaacgttaaccgtaggtacgtacgtaactaaagtttaattaacgttaacgttaaccgtaacccgttaccgttaacgggtccttaccgttaaccggttttcggggaccgggttaagggttacccgtaaggggtacggtaacgtaacgtaaccgttaaacgtaacggttcggtaacgg

SEQ ID NO: 437357 - DNA, 665 bp, Homo sapiens
  misc_feature: GZ8MTXP01AU4FU.13.38.D05.1.454.CMB.2.raw
  modified_base (375)..(375): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaactcttaaattggtatcagcagaagtcagggcaagccccgaacctcctgactctacggtacatccactttgcacagtgggatcccatccaaggttcagtggcaagtagctctagggaaactacgtacttttaccccnctaaccgattacggacggggtacctaacgacggcccttaggtaacgtattttcgacgttacttacgttaatttcgtactaaacgtggttaaacgttaaccccttccgtacccccggggtacgtttaccgggaccgtaaaccggggtaaccgtaaacgggggtaacggaaaacgttaaccgtaaacggaccgggtaaacccgttaggtacgggtaccgttacgaccggttaacccctggtttaccctttccggtccttaccgttaacccttccccgttccccgtaaccccg

SEQ ID NO: 437358 - DNA, 647 bp, Homo sapiens
  misc_feature: GZ8MTXP01AWI23.13.38.D05.1.454.CMB.2.raw
  modified_base (342)..(342): a, c, t, g, unknown or other
  modified_base (386)..(386): a, c, t, g, unknown or other
  modified_base (457)..(457): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtcaccatcacttggcgggacaagtcaagaacattggactaacttacttttaaagttggtatcgagcaagaagtcgacgggaccaacggccccgaactcctagactcgtacggtacacgttcctacgtttgacacgnggtacggactacccataccgtaggttcgagtggactaagacgtntcgtaggaaactacgttacctttacccactacctacgtacgtacgggtactacgacgtacgtaagtagttntttacgacttactttacgtattacgtaacgtaacgtacgttacccgtttacccgttccccgtaccccggtacggttaccggaaccggtaaccggtaacggtaacggtaggaaacgtaacgaacggacgtacgttcgtcgtacgttcgccttaccgtaattcgtcttctcgttaccttccgttcccgtaac

SEQ ID NO: 437359 - DNA, 656 bp, Homo sapiens
  misc_feature: GZ8MTXP01B7SXE.13.38.D05.1.454.CMB.2.raw
  modified_base (246)..(246): a, c, t, g, unknown or other
  modified_base (330)..(330): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggacgggccaccatcaactgacaagtccagccagtagttgtttanacagctacaaactaataagtaacttctagcttaggaccagacaagaaaccaggacacgtcctacaagctgacttctatttacgnggactagtcgtacgtccggggaacgtcccggggttacccccacggaccgtagttccgaggtcggcgtgggtccgggtacgtaggggaacctaggttacctttacaccttcctaccacctaactcgacgcacggtcctgaccgaggctaggaaagtcgtggggtagtaccgttagtttaactcgtgtaaccgtagtaaactaaattacgttaacgttaccgttaacctcccggtcgttaacgggtccttacggtaccggtttacggggacgggttaacgggttaccgtaaggggtcgaagtacgaacgaacgtaacgttggtaaccg

SEQ ID NO: 437360 - DNA, 648 bp, Homo sapiens
  misc_feature: GZ8MTXP01CYXG4.13.38.D05.1.454.CMB.2.raw
  modified_base (244)..(244): a, c, t, g, unknown or other
  modified_base (305)..(305): a, c, t, g, unknown or other
  modified_base (458)..(458): a, c, t, g, unknown or other
  modified_base (488)..(488): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggtcttgggtaagcccgggggtcctnagactctcctgtgcaacctctggtattctattttctctgacgtctggtgagcgtgggtccnccgaggccgtcccgggagggctgggagtggtggcgtattaaagggtagaagtacagtggtacggaactaacacgaccctacgagttcgttaccccgtaggaaaaacgggtcaaggtacttacgacttatcctacaaagacgatacgaactaanaaaagtaataggaataattatactagaaanaaataactaacgaacggtaacgaaacgaacgaacgaacgaacgacggtacgtacgtaacttactacgtacgaacgaagagacggacgagtagtacgacgacgacggaacggacggtaacggtacggtacggttaccggtaaccgggttcggggtaaccgg

SEQ ID NO: 437361 - DNA, 713 bp, Homo sapiens
  misc_feature: GZ8MTXP01B4M4J.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatctacttgtcggacaagtcagaacattggactaacttctttaaattggtatcagcagaagtcagggcaacgcccccgaactcctgactcgtacgtacacttcctatttcgcacaggtggactcccattaccgaaaggttcgaggttcgggactaaagggtaataacgttacgtacgggtaaactacgttaaccttttaaccccacgtaacctacgttacgtacgggggttaccttaacgacgtacccgttaaggtaaagttacgtttttacggaaccgtttaactttaaccttaagtttacggtaaacctaaacgttaaccggtttaaccgttttaccccgtttacccccggtacccccggttacgggtttaccccggaccgggtaaaccgggaaaccggtaaagggtaacggtaaaacgttaaccaagggttacgtaaaccgttggtcggtacgcttaccgactaacgtcttcgttaccttcttacttcccttcccgtaaccc

SEQ ID NO: 437362 - DNA, 742 bp, Homo sapiens
  misc_feature: GZ8MTXP01DOUQI.13.38.D05.1.454.CMB.2.raw
  modified_base (251)..(251): a, c, t, g, unknown or other
  modified_base (352)..(352): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatcgacccagtctccagacctcccgtggctgtgtctcgtgggcgaggacggccaccatacaactgacaacgtccagccagtagttagtttaanacagacctaaccaaataaataaacgtacttacttacgcgttacggaacccagaccaagaaaccgaggacacgccctacaagctacgctactactttacggnggactactacgtacggtaccgggtaacgtcccccggggtacccctacggtaacgtatttaccggacggtacgggaccggtaacgggtccggggttaaccgttacgggggaaacctaacggtttacctttacccgaccttaccctaccaacccgtactacgacgaccgacgtcgtacgacgacggacgtaaggaaagtcggttaggggtacggttacgtttaagttttacgttacgtcggtactaagtaaacttaacttaattaacgtaaccgttaccgtaacccgtacggttacgttccgttaccgttaccgggtttcggggaaccgggttacgggaaccggtaagggtaggtaacgtaacgtaacgaaacgtaacggttcggtaaccgg

SEQ ID NO: 437363 - DNA, 641 bp, Homo sapiens
  misc_feature: GZ8MTXP01CJJEP.13.38.D05.1.454.CMB.2.raw
  modified_base (240)..(240): a, c, t, g, unknown or other
  modified_base (252)..(252): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccacatcaactgacaagtccagccagagttgttttanacagtctacaanaataagacttctagcttaggtaccagacaagaaaccaggacagtcctactaagctgcctactattttacgtgggactacgttcgttaacgtaccggggtaacgttccccgggggtcccctacgggaccgtattcccgaggttcggacgaaggtcggggtcacggggactaggtacttcactctcacatacagcagcctgcgagtctagaagtagtggggtcggtacgttagtttacttaccgtagttacagtactaaattattacgtaacgtcccgttaaccgtcggttacgtccttacgtaaccggttttacgggaccgggttacgggaacccgtaaggggttacggaacgttaacgaccgttaaaaccggtccgttgggttaaccgg

SEQ ID NO: 437364 - DNA, 822 bp, Homo sapiens
  misc_feature: GZ8MTXP01AXT97.13.38.D05.1.454.CMB.2.raw
tcagtcacgtactacacgaccggtgctcgatttagtatctgatagttgggtttggggggagtcagtctcagtcaggacacagcatggacatgagggtccccgctcagctcctggggctcctgctactctggctccgaggtgccagatgtgacatccagatgagccagtctccatcccaccctgtctgcgtctctcggagacgagggtccaccatcacttggtcgggcaagtcaagaacattggactaacttcttaaattggtatcagcagaagtcgacgggacaaccgccccgaacctcctagactctaaccggtacacttaccctacttttacgaccgtaacgtacgggttacgggggtaacctacccccgtaagtttaaccccggtaaacggggttttaccgaaaggggttttacgggggaacccgttaaaaaaggggttaaacgggtaaccgtttaaccgggttaaaccgggtaaaaaccgttaaccgggtttaaaccctttttaaaccccccggtacctaaacccgtacgtttaaccgggtaacggggggttaccttaaccgaaccggttacccgttaacggtaaaggtttacgtttttacgggtaaccggtttaaaccttttaacttaacgtttacgggttaaacctaaacgtaacggtttaacgtttaccccgtttaccccgtacccccgggtacgtaccgggttaacccggaacggtaaccggtaaggtaacggtaaacgaacgtaacggagtaacgttgtacggtcgttacgccttactaagtactcttacgttcttacttccgttccgtaacc

SEQ ID NO: 437365 - DNA, 656 bp, Homo sapiens
  misc_feature: GZ8MTXP01EVWZ8.13.38.D05.1.454.CMB.2.raw
  modified_base (242)..(242): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtggcgaggagggccaccataaactgacaagtccagccagtagttgttttanacagctaccaaacaataaagtacttcttagctggtaacagcaaagaaaccaggacacgcctactaagctgctctatttacgtggcattctagtaccgggaacgtcccggggtcctacgaccgtatcgaggtcggacgacgggtcgggttacgtacggggactagttaactttccgacttacccttaccacctaactcgacgactacgcccgttgaccgaggtctagaagtaagtcggtaggggtacgtttaagttttacttaaggtctaccgtaatacttaaatttacttaattacggttacctcccgtaacggtcgttcctaccgttaccggttcgggacggggttaacggttaaccgttaaggggtaacgaagtaacgtaacgaaacggttaacgtggttaacgggtaaccg

SEQ ID NO: 437366 - DNA, 769 bp, Homo sapiens
  misc_feature: GZ8MTXP01BFL8P.13.38.D05.1.454.CMB.2.raw
  modified_base (199)..(199): a, c, t, g, unknown or other
  modified_base (222)..(222): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcgganacgaggtcacatcattggcgganagtcaagaactagtacgactaacttactttaaagttggtactacgagacaaggaacgtcgacgggaccaaccgtcccccgaaccttccgtaggtacttaccgtaacggtaactacttacccgttatttcgactacgtaggtacggactacccgataccgtacggttagacggtgacctaaaagggttcaacgttacgtacggtaaaaccttgtttaacccttttaccccgaactaccgtacgttacggtacggggttaccaacgtacgtaccgttaagtaacgttacgtttacgaccgttactttacgttacgttacgtaacctaacggttaacgttaacccgtttaccccgttaccccggtacccccgggttaccggtttaacccgggaaccggtaaacccggtaaacgggttaaaccggtaacggtaaacggtaacgtaaacggttaccgggtaaagttcgggtaacgttcgacccgggttacacccttaaccggttaccttcgggttaacccttcggttaccccttccgtttccccgtaacccg

SEQ ID NO: 437367 - DNA, 681 bp, Homo sapiens
  misc_feature: GZ8MTXP01DKIWZ.13.38.D05.1.454.CMB.2.raw
  modified_base (242)..(242): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaactgacaagtccagccagagtgttttanacagcctaccaacaataagaacttactagcttaggtaccagacaagaaaccgagggcacgcctacctaagctcgcttactatttacgtgggtactattcttaacgtacccggggtaaacgtccccgggggtccccctacggaaccgtattccgaaggtcgggaccgaagggtcggggtccggtaggggactaaggtactttaccaacctccttacaaccctaatccaagccaacgtcccgttacgacgggtaccttaaggaacgtagttacgggtggggtaccgttaagggttttaacttaccgtggtacctagataaatttattaatactccttacttcccgtccgttcgggtaccgtttaccgggaaccgtaacggggttaaccgaggggttaacgtaaacgttaacgaaacgtaacgtgttacgtcgttgtaaccc

SEQ ID NO: 437368 - DNA, 623 bp, Homo sapiens
  misc_feature: GZ8MTXP01EUZUV.13.38.D05.1.454.CMB.2.raw
  modified_base (179)..(179): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactggtggtcgacccagganccatcgttctcagtgtcctccgtgggaggacagtccacactcacttgtgtcttgagatacggctcagtctactagtacgttacctacccagctaggaccaacacgacccaggccaggcctccgcgcacgctcactcaacaacaacaaacactcgcttcttcgtcggtccctcactcgtcttctctcgctcctactaccgtacgggaaacaacgtctacgtcccttatctacgtaccggaccggggcccaggacaagtaacgatagatctagtatttaagttacgttgtttactttacgtttagttagttgggttagtcgttaccttatttcgtcgtcgttggttggtttcggggacggaccgggtaccgtcccggttcgttccggttaccccgttccggtcggtaacccgaccggtacccgacggtcccgttccggtaaccccg

SEQ ID NO: 437369 - DNA, 765 bp, Homo sapiens
  misc_feature: GZ8MTXP01B228G.13.38.D05.1.454.CMB.2.raw
  modified_base (239)..(239): a, c, t, g, unknown or other
  modified_base (328)..(328): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctgtggcgagaggccacatcaactgacaagtccagccagtagttgttttanacagctacaaacaataagtaacttcttagcttaggtaccagacaacgaaaccaggacacgaccctactaagctcgactactatttacgngggactattccgtaacgtacccggggaaacgttccccgggggtaccccctacggtaaccgtacgtttaccgacgggttcgggaccgtaacggggcgggggtttacccgttaggggggaaaccctaaaggggttaccttttacccaaacccgttcccttaacccgaaacccctaaacgttccgaaaccggtacccgaaaccggttccccgttaaggccggtaaccgggtaccgtaacgggaaaacggttggtttaccgggggttaggttaaccggtttaaaggtttttaaacgttaaccgttcggttaccgaagttaaacctaaatttaagtttaaacgtacgtaccttaacccgtaccgttacggtaccttcgtaaccgtcggttacggggcgaacggtaaggagtaacgaacgtacgaaacgtaacgttgtaacgg

SEQ ID NO: 437370 - DNA, 556 bp, Homo sapiens
  misc_feature: GZ8MTXP01COEOF.13.38.D05.1.454.CMB.2.raw
  modified_base (240)..(240): a, c, t, g, unknown or other
  modified_base (253)..(253): a, c, t, g, unknown or other
  modified_base (265)..(265): a, c, t, g, unknown or other
  modified_base (312)..(312): a, c, t, g, unknown or other
  modified_base (320)..(320): a, c, t, g, unknown or other
  modified_base (359)..(359): a, c, t, g, unknown or other
  modified_base (382)..(382): a, c, t, g, unknown or other
  modified_base (387)..(387): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtggcgagagggccaccatcaactgcaagtccagccagagttgttttaanacagctaccaaanaataagaacttnttagcttaggtaccagcaagaaaccaggacagcctactaagctgctnatttacgngggcatctagtccgggaatccggggtccccctggaccgnttcgagtcgggcaagggcggtcnggganagatttcactctcacatcagcagcctgacgagtcgtagaagtagtggggtgtacgtagtttacttatcgtacagactaagttattatacgtactccgtcgacggtcttcgtacgttcggcgggaggaccgaaggtacggaagtacgtacgaaacgtcgttcggtaacgg

SEQ ID NO: 437371 - DNA, 521 bp, Homo sapiens
  misc_feature: GZ8MTXP01CIN4Z.13.38.D05.1.454.CMB.2.raw
  modified_base (405)..(405): a, c, t, g, unknown or other
  modified_base (494)..(494): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctacaacaataagaacttctagcttggtaccagcagaaaccaggacagcctacaagctgctcatttactgggcatctatccggaatccgggtcccctgacatcagtgcaaggcggtctgggacagtactttcactctacacatcagcagcctgcaggctagaantgggtgctagtttaactactgtcagtactaaattatatacgtctctcgagcttcgtacgtttcgggacggagggaccgaaggtgggaanacgtacgaaacgtaacgttggtaacgg

SEQ ID NO: 437372 - DNA, 982 bp, Homo sapiens
  misc_feature: GZ8MTXP01AWNMZ.13.38.D05.1.454.CMB.2.raw
tcagtcacgtactacacgaccggtgctcgatttagtatctgatagttgggtttggggggagtcagtctcagtcaggacacagcatggacatgagggtccccgctcagctcctggggctcctgctactctggctccgaggtgccagatgtgacatccagatgagccagtctccatcccaccctgtctgcgtctcgtggagacgagggtccaccatctacgttgtcgggacaagtcaagaactagttcggactaacttactttaaagttggtatcgacgacgaagtaagtacgaacgggaccaaaccggcccccgtaaacccttcccgtaaggtaacctttaccgttaaaccggtaacctaaccttacccgttacgtttcgaccgtaacgtacgggttacgggaacccttaccccgtaattaaccccggtaaacggttacgtaacgggtacgggtaccgtaaagggtaacgtaacgttaccgggtaacggttaaaccgtaacggttttaacccgtttttaccccaaccgttaaaccccgtaaagggtttacccggtaaacggggggtttacccaaacccgggttacggtaaccccggtttaaagggttaaaggttttaccggtttttaccggggtaaacccgtttaacccttttaaacgtttaaacgtttttccgggaaacccttaaaacgggtttaaccgggtttaaaccccgtttttaaccccccgggttaccccccgggtttaacccccccgggggttaacccgggggttacccggttaaaccccggggaaaaccggggtaaacccgggggttaaaacgggtaaaccggggtaaacgtaaacccgggtaaacgggttaaccgtaaaccggggtttaaggccgggggttaaccttcccggacggttaacccctaagtttccgttaaccgggtttccctttaacccgggttcccttttaaccgggttaacccccgtttaaccg

SEQ ID NO: 437373 - DNA, 577 bp, Homo sapiens
  misc_feature: GZ8MTXP01AIS8I.13.38.D05.1.454.CMB.2.raw
  modified_base (369)..(369): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactggtggtgacccaggagccatcgttctcagtgtctccgtgggaggacagtcacactcacttgtggcttgagatacggctcagtctactagtagttacctacccagctcggtaccaacacgaccccaggccaggcctccgcgcacgctcactctaacaacacaaacactcgctcttcgtcgggtccctcactcgcttctctcgcctccnttccgtagggaacaaagctcgtcccttatcatccgacgggggcccaggacagaacgatagaatctagtatttagttacgttgttgtttacgtttatagttgggttagtcgtcctagtttcgtgtcgttggtggttacgggtggacggtccgaccggttcgttccggttaccgtccgtcgtccgacgcccgacgtccgccgtaaccccg

SEQ ID NO: 437374 - DNA, 615 bp, Homo sapiens
  misc_feature: GZ8MTXP01D08O7.13.38.D05.1.454.CMB.2.raw
  modified_base (197)..(197): a, c, t, g, unknown or other
  modified_base (283)..(283): a, c, t, g, unknown or other
  modified_base (339)..(339): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcaagaacattggacaactctttaaatggatcagcagaatcagggcaagccccgaacncctgatctacggtacatccactttgcacagtggatcccatccaaggttcagtcganaagtagctgtagaaacatactttaccacaaccaagtccgtaaggggtcctaacgagtacgttaagtaagttatttacgacttaacgttaattaattacgtaacgtaaacgtaacgttaaccgtttacccgttacccgtaccccggtacgtaccggaaccgtaaacggtaaccggaaacggtaacggtaaacgtaacgaaacgaacgtaacgttacgtacgtacgttacgttcgactaactacgtcgttcttacttacttaaccgttcccgtaaccg

SEQ ID NO: 437375 - DNA, 752 bp, Homo sapiens
  misc_feature: GZ8MTXP01C6GF3.13.38.D05.1.454.CMB.2.raw
tcagtcacgtactacacgaccggtgctcgatttagtatctgatagttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcacatcacttggtcggacaagtcaagaactagttcggactaacttactttaaagttggtaatcagacgaagaagtcgaaggggaccaaaccggacccccgtaaacccctcgtactaacgttaaccgtaaccgtaaccttacctaccgttacgtttaccgaacgtacggtagggtaccggtacccctacgtaacgtaaccggttaacggtacgtagggtacggtaaccgtaaaggttaacgtaacgttacggtaaacggtaaaccgtttaaccgtttaaccctttaccccgtaacaacgttacggttacggtaaccgggttacaacgtacggtaccgtaaaggttaactttgtttaccggaactttaacttacttaacgtactaacgtaaccggttaactttacccgttaccccgttaccccgggacccttaccggggttccaaacggtaacggtaaacggttaggaacgtaactaacggaacgacgtaacgttggacgcttagccttacgtctacttcttacctcttacccgttccttcccgtaacg

SEQ ID NO: 437376 - DNA, 833 bp, Homo sapiens
  misc_feature: GZ8MTXP01CHDTX.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaattggtatcagcagaagtcagggcaacgccccgaactcctgatctacggtacatccactttcgacacgtaggtgggactccccaagttacccgaaacgggttttcaacggggtttaggacccgtaaagggttaacggtaagttccggttaacggggaaaacctacgggtaaccttttttaaccccccgtccaaaccccgtaacgttacccggtaacggggggtttccctaaaccggtaacgtaccccggttaaaggtaaaacgggtttaacgtttttccggaaccgggtttaaaccctttaaaccgggtttaacttttaacggtttaaccggtaaaaccgttaaccggggttaaaccggtttttaaaccccgttttaccccggttacccccccccgggttaaccgggtttcccgggtaaccccggtaaaccgggggtaaaccccggtaaacggggttaaacgggtaaaaccggtaaacgtaaacggacccggtaaaacgttcggtaacggggtcgttaccggcgacccgttaactaccctttaacggtttaccgttccttaagttccccttccccgttaaccccg

SEQ ID NO: 437377 - DNA, 648 bp, Homo sapiens
  misc_feature: GZ8MTXP01AZ907.13.38.D05.1.454.CMB.2.raw
  modified_base (263)..(263): a, c, t, g, unknown or other
  modified_base (284)..(284): a, c, t, g, unknown or other
  modified_base (309)..(309): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgcttaattttaaaaggtgtccagtgtgaggtgcaaggtggtggaggtcggtggggggggcttgggtaacggcccgggggtcctcagactctcctgtncaactcgtggattctatttcnctgacgtctggtgagcgtcggtccncgaggccgtaccgggaggctggagtgggtcggacgtagtaaggagagacagtggacgacaacgagacctacaggtcgtccgtagaaaagggcaagtacttacgactacgtcacgaaagatatacgaataacaaaaggtaatagtaataatatctaagactaaaatacgaaaaccaaacggtaaggaaacggacgaaacgacgaacgacgggtacgttaagttataaaccgttcgtaaaccgacggtaaaagtggttaccggggaccaaagtgacgaaccgttaagttccgggaacgtacggaacgtagtccgaacgtaaccgggttcggggaaacccgg

SEQ ID NO: 437378 - DNA, 767 bp, Homo sapiens
  misc_feature: GZ8MTXP01A7VY3.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccactcccaccctgtctgcgtctcgtcggagacgagggtacacctatctacttcggtcggggacaaagttccaagaaactagttcggactaaacttacttttaaaagttggtaacttcgaagacaagaacgtacgacggggaccaaaccggtcccccgaacccttccgtagtacttaccgtaaccggtacctacttacccttactttcgacgtaacgtaggttcgggacctaccccgtatacccgtaaacggtttcagggttacggaccgtaaagtacggtaattcggtaacggaaactacgtttaccttttaccccgactaaccctagttacggacgggttacctacgtacgtccgttaaggtaaagtttcgtttaccgtacgttaaactttacttaagtttacgtaactaaacgtaacgtttaccgtttaaccccgttcccggtaacccccggtacgggttacccgaaccccgggtaaaggtaacccggtaaccggtaaggtaaacgtaacgtaaagaccggtaacgttgggtacgtccgttacgttaaccttcgtaacttcgttaacttctacttccctccgttaacttaaccg

SEQ ID NO: 437379 - DNA, 785 bp, Homo sapiens
  misc_feature: GZ8MTXP01BS2ZM.13.38.D05.1.454.CMB.2.raw
  modified_base (247)..(247): a, c, t, g, unknown or other
  modified_base (263)..(263): a, c, t, g, unknown or other
  modified_base (265)..(265): a, c, t, g, unknown or other
  modified_base (274)..(274): a, c, t, g, unknown or other
  modified_base (280)..(280): a, c, t, g, unknown or other
  modified_base (288)..(288): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggtatttttcctcgctgtcttaattttaaaaggtgtccagtgtgaggtgcaagtggtggagtcggtggggggcttggtacgcgtgggggtccctnagctctctgtgcactngnttcatttcnctgacncgtggtgngtcgtcgggtccgccgaggccgtcccggggaaggggtcgtagggtaggtcgggggttacgaccggttaagtaaacgggtaagaacgtagaggttcggacggaacaaaccgtaggacctagacgttcgttacccgaagaaaacggctaagtaactacctaacgtactacgtaacgaaagtagtaacgtaacgtaaactaaaactaaaagtaaaagtaaagtaaattaaagttaacgtaacgtaacgtaaactaaaacgtaaacgtaaaaccggtaaaaccgtaaaacggaaaacggaaacggaaacggaaaccgaaacggtaacggtacggttaacgttaacgttaaccgttaaccgtaacgtaacgtaacggttaacggtacggttaacgtaacgtaacgttaacgttaaacggttaccgggtaaccggtaccggtaaccggttaaccggttaaccggttaaccggttaaccgggttaacccgggggtaacccgggg

SEQ ID NO: 437380 - DNA, 738 bp, Homo sapiens
  misc_feature: GZ8MTXP01BVVII.13.38.D05.1.454.CMB.2.raw
  modified_base (233)..(233): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgccacgggacgatcgtgatgaccagtctccagactccctggctgtgtctctggcgagaggccacatcaactgcaagtccagccagagtgttttanacagctaccaacaaataataacttacttagcttcggtacagacacgaaaaccaggacacgcctacctaaagctagtcctactatttacgtgggactagttctacgtaccggggaacgtccccggggtaccccctggtaccgtagtttcaggtacgggccgaacgggtcggggttcgtaacgggggaactacgggaaactttttccaaaccttcctactaaccctaacggtaccaaacgccgaacggccgttaacgccggaggtaccgtaggtaaacgtaagtcgggggtttacggggtcttaaaggtttttaactttaaagttcgggttaaccaagggtaaaccgttaaattaaagtttaagttaacggttaaccctccggttacccgacggggtccttacgttaaacccggttttcgggaccggggttacggggaaacccggtaaaggggttacgggaaacgtaacgttaaaccggaaacccgttaaaccgttaacgggttcgg

SEQ ID NO: 437381 - DNA, 592 bp, Homo sapiens
  misc_feature: GZ8MTXP01DXX36.13.38.D05.1.454.CMB.2.raw
  modified_base (237)..(237): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgaccccagtctccagactccctggctgtgtctctggcgagagggccaccatcaactgcaagtccagccagagtgtttanacagcctaccaacaataagaacttctagcttaggtaccagacaagaaaccaggaacagaccctactaagctcgctactatttactgggctatctacgtccgggaacgtcccggggtccccctggaccgtattcgaggtcggcgcggcggggtcgtagggaactacgtatttcacttctaccacctatcagcacgcctgacgaggctagaagtagttggggtacgtacttagtttacttactgtacagtactaattagttatacgttcctcctcggacggtccttcgtaacgtttcggggacgggacgggttaaccgaagggtagaaggtactacgaaacgtaaccgttgtaacgg

SEQ ID NO: 437382 - DNA, 792 bp, Homo sapiens
  misc_feature: GZ8MTXP01EL80A.13.38.D05.1.454.CMB.2.raw
  modified_base (761)..(761): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccactcccaccctgtctcgcgtctcgtcggagacgaggtcaccatcacttggtcgggacaagtcaagtaactagttcggactaacttacgttttaaaagttggtaatcgagacgaagtaacgtacgacgggaccaaaccggacccccgtaaccttccgtaggtaacttaccgttaaccggtactaacttcccgttacgtttacgaccgtaacggtacggttcgggaaccttacccctaagttaccccggtaaacgggtttcgaaggggttacggaaccgtaaagggttaaacgtaacgtttaccggtaacgggtaaaacccttaacgttttaaaccccgtttttaccccccaacgtaaacccgttacgtaccgggttaacggggttacctaaccggtaccgtaccgtttaaaggttaaacgtttgttttacggaaccgttaacctttaactttaagttacgttaaccgaaacgttaaccgtttacccgtttaaccccgtccccggttaccccggtacgggtaccgtaccggtaaacgacggtaacggtaagaactaacgaagttacgtacgttgtacgtcttacgcaactntactcgttctcgttacttccgttccgtaacc

SEQ ID NO: 437383 - DNA, 686 bp, Homo sapiens
  misc_feature: GZ8MTXP01A651H.13.38.D05.1.454.CMB.2.raw
  modified_base (544)..(544): a, c, t, g, unknown or other
  modified_base (548)..(548): a, c, t, g, unknown or other
  modified_base (589)..(589): a, c, t, g, unknown or other
  modified_base (606)..(606): a, c, t, g, unknown or other
  modified_base (611)..(611): a, c, t, g, unknown or other
  modified_base (618)..(618): a, c, t, g, unknown or other
  modified_base (632)..(632): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgcttaattttaaaaggtgtccagtgtgaggtgcaagtggtggagtcggtggggggtcttgggtacggcccggggtcctcgagtctctcctgtcacacctgtgtacttctatttctcgtgacgtccttggtgacgtcgtcgggtcccgcggacgggtcccggtaccccggggaaggggtccgtggggtacggtttggggttcggtaaccggtttaaagttaaaagggtaaggaaacggaacgtagttacgggtaccgaaacaaacgaacggtaaccctacggtagtacccggttacccgaaggaaaaacgcgaagtacttaccaacttacgtactacgaaagacgtatagaaactaaagaaaagtatagaaacttatangtanaacaaatacgaaacaggtaagaaacgcgaaagtacagacgngttaacgtactacgtanaaccngtaaagngttcggacttagancgaacgttaggccgaacgacgtaacggtactcggacgtaacggggcggaaccgg

SEQ ID NO: 437384 - DNA, 781 bp, Homo sapiens
  misc_feature: GZ8MTXP01AF6EX.13.38.D05.1.454.CMB.2.raw
  modified_base (242)..(242): a, c, t, g, unknown or other
  modified_base (254)..(254): a, c, t, g, unknown or other
  modified_base (265)..(265): a, c, t, g, unknown or other
  modified_base (287)..(287): a, c, t, g, unknown or other
  modified_base (316)..(316): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccacatcaactgacaagtccagccagtagttgttttaanacagctacaaanaataagacttntagcttggacagacaagaaacngacagcctacaagctgctactatttacgngggctagtctacgtccgggaacgttcccggggtcccctacggaccgtaagtttccgagggttcgggaccgtaagggtccgggggtacgtacgggggacctaaggttacgtttttaccccgaaaccttcccttacccgaacccttaactaccggaacggtacccgaacgggtccccttaggaccggtaacggggaccgttaagggaaaacggttcggtttcggggggtaacgggttaaccgtttaacgttttaaacgtttaaccgtttgggtaaccaaggttaacctaaaggtttaactttaaacgttaaccgttacccgtttaacccggtaccggttaacggtcccttaccggttaaccgggtttcccgggggaacgggttaaccggggaaaccccgggtaaggggttaaggaaacgggttaaccaaaccgggttaaaaacccggtaagttcgggggttaacccg

SEQ ID NO: 437385 - DNA, 703 bp, Homo sapiens
  misc_feature: GZ8MTXP01AIV5B.13.38.D05.1.454.CMB.2.raw
tcagtcacgtactacacgaccggtgctcgatttagtatctgatagttggggtttggggggagtcagtctcagtcaggacacagcatggacatggagggtccccgctcagctccgtggggctcctgctactctggctccgaggtgccagatgtgacatccagatgagccagtctccatccctccctgtctgcatctggtaggagacagagtcacatcacgttggccgggacaagtcagagctaacttaacctaacttatttagaaattaggtaactaccgaaaaccgaaaaaccggagggaacgaccgacccccttacacccttccttatcttaagtcgggttacacctaactaccccgaacctttaaacgaaacgggttccggggtacccagttaccgtaacggttacaggtacggcctacgttaggggaacttcggtagggaacctagttacctttcgacctactacccactagtacagtctacgttcgacgaccaacgtaggtaaattcgttttaacactttaaacttacgttacttacgtaactaaacgagttacggttacacgggttaaccgggcttaccgggtacggaaccgaaaggggtaaccgtaaagggttacggtaaacttaaacggaaacccgttaggttagggccgttacgtaacgcctaacgttatcccgttagttccttaacgttaaccc

SEQ ID NO: 437386 - DNA, 739 bp, Homo sapiens
  misc_feature: GZ8MTXP01AMW7P.13.38.D05.1.454.CMB.2.raw
  modified_base (226)..(226): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccacctgtctgcgtctcgtcggagacgagggtcaccatcgtacttggtcggnaagtacagaaactagttaggactaacttactttaaagtggtatcagacgagaacgtcgagggaccaaccgacccccgtaactccgtagtactacctaaccggtataacctacccgtaccttacgtactaccgaggtacggtacgtccctacgtaacgtacggtagtacgaggtacgtaaacgtagtaacgtcgtacgggtaactaacgttacctttaacctaccctacacgtacggtaacggtccgtaactagacccgttacggtaagttacgtttacgtaggtaacctttaacttacgtacgttaacggaacgtaacgttaccgttaaaccccgtttcccgttccccgggtacccggttaccgggtaacccgaaaccggttaaccgggaacgggttaaccggaaaggtaaccgttaacggaaacggtaccgttaacggtcggtaacggttccggccttaccggtaacgtcccgttaactttccggttctttaccctcccgttcccttccccg

SEQ ID NO: 437387 - DNA, 637 bp, Homo sapiens
  misc_feature: GZ8MTXP01A9EA1.13.38.D05.1.454.CMB.2.raw
  modified_base (300)..(300): a, c, t, g, unknown or other
  modified_base (549)..(549): a, c, t, g, unknown or other
  modified_base (585)..(585): a, c, t, g, unknown or other
  modified_base (598)..(598): a, c, t, g, unknown or other
  modified_base (603)..(603): a, c, t, g, unknown or other
  modified_base (632)..(632): a, c, t, g, unknown or other
tcagtcacgtactacacgaccggtgctcgatttagtatctgatagttggggtttgggggagtcagtctcagtcaggacacagcatggacatgagggtccccgctcagctcctggggctcctgcctactctggctccgaggtgccagatgtgacatccagatgagccagtcctccactcccaccctgtctgcgtctctacggagacagggtccacatcacttggcgggacaagtcaagaactagttgactaacttactttaaattggtatcagcaagagtcaagggcaacgccccaactcngactctacggtacatcctatttcgacaacgtggtacggacctcccgaattccgaaacggtttcagggttcggactaaggtacgtaataccggtacggaaacgttacgttaaccctttttaccccgactaaacccgtacgttacggtacggggtactaaccgtacggtaccgtaagtaaacgtttatttacggacttaactttactattcgtacaaacgtagttaccgtttaccctcccggtaaccccgngttaccggacgaaaccggtagtaacggtagaacaanaacggcagttcgnacgcncacctaagtcttcgtactcttacgttccnccgtc

SEQ ID NO: 437388 - DNA, 765 bp, Homo sapiens
  misc_feature: GZ8MTXP01ETOW3.13.38.D05.1.454.CMB.2.raw
  modified_base (169)..(169): a, c, t, g, unknown or other
  modified_base (221)..(221): a, c, t, g, unknown or other
  modified_base (262)..(262): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcnccatccaccctgtctgcgtctcgtcggagacgaggtcaccatcacttgcggnaagtcaagaactattggactaacttacttaaagttggtatnagacagaagtcgagggccaacgccccgaactcctagactctacggtacactcctacgtttcgacacgtaggtcggaactccccaagtacccgtaaagggttcaaggtcggactaaaggttaagaacgttaccgttaagggaaacccttaggttaaaccctttttaacccccactaacccctaagttaccggtaacggggttacctaaccgtacggtaccgtaaggttaaacgtttactttacgggaccgttaactttaaccgttaagtttaccggttaactaaaaccggttaacggttaaccgttttaacccccgttaccccggttaacccccccgggtaaacgggtttaccgaaaccccgggggtaaaccggtaaacccggggtaaacgggttaaaccggggaaaactaaaccggtaaacggttaccggtaaacggttacggtacggtcgttacgaccgaacttccgtacttcgttcttacccttgttcccttcccgtaacc

SEQ ID NO: 437389 - DNA, 874 bp, Homo sapiens
  misc_feature: GZ8MTXP01BP8IR.13.38.D05.1.454.CMB.2.raw
  modified_base (265)..(265): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgcttattttaaaaggtgtccagtgtgaggtgcaagtggtggagtcgtgggggggcttggttaagccgtgggggtccctcagactctctgtgccaacctntggtattctattttctctgacgtcctggttgacgtcgtcgggtcccgccgagggccgttaccccgggggaaacgggggtccgtggggaaggttgggggtttagggtaccccggttaaagtttaaaaggggtaaggtaaaggaaccgtaagttacggggtaccggaaacgaaaccgtaacgaaacctaacgaggttacgtttacccccggttaaagggaaaacgggcgaaaggtaactttaccaaacttaactactacgtaaagtaacgtaagtacggtaaacctaaaccgtaaaaaaggtaaaattaaggtaaattaaacttaaacttacccggttaaaacgaaacgtaaaacgtaaaccgtaaaaccggtaaaaccggtaaaacggaaaaaccgggtaacggaaaacgggtaaaccgaaacggtaacgggttaccggtttaaacgtttaaacgtttaaaccgtaaccgtaaaccgtaaacgaacggttaacggtaccgggaaccgtaaaggtaacgttaacggttaacgttaaacggtaaccgggtacccggtaaccggtaacggtaccgggttaccggtaacccggttaacccggggtaaccggggg

SEQ ID NO: 437390 - DNA, 681 bp, Homo sapiens
  misc_feature: GZ8MTXP01A2R05.13.38.D05.1.454.CMB.2.raw
  modified_base (241)..(241): a, c, t, g, unknown or other
  modified_base (255)..(255): a, c, t, g, unknown or other
  modified_base (311)..(311): a, c, t, g, unknown or other
  modified_base (330)..(330): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgcaagtccagccagagttgttttanacagcctaccaaanaataagaacttctagcttaggtaccagacaagaaaccaggacagccctaccgtaanctcgcctactagtttacgngggactagttacctacggttacccggggtaacgttcccccggggggttacccccctcggtaaccgtacgtttacgacggttcgggccgtaacggggtccggggttacccgtagggggacctaaggtactttcgaaacccttcgtaccaacccataccgagcgtaacgcctacggcgaggacttaggaaagtacgtggggttaggtaccgttaagtttacgttacgtgtaccagtaacctaattacttagtacttcccgtccgtccggagtccttaccgtacggttcgggacgggttacggttaaccgtaaggggtagaacggtaactaccggaaaacgtcgttggaaccgg

SEQ ID NO: 437391 - DNA, 629 bp, Homo sapiens
  misc_feature: GZ8MTXP01AT7UN.13.38.D05.1.454.CMB.2.raw
  modified_base (246)..(246): a, c, t, g, unknown or other
  modified_base (297)..(297): a, c, t, g, unknown or other
  modified_base (335)..(335): a, c, t, g, unknown or other
  modified_base (414)..(414): a, c, t, g, unknown or other
  modified_base (444)..(444): a, c, t, g, unknown or other
  modified_base (482)..(482): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagactccctggctgtgtctcgtgggcgagacgggcccacataccaactgacaagtccagccagtagttgtttanacagcctacaaacaataagtacttctagcttaggtaccagacaacgaaacncggacacgcctacctaagctcgtcttactagtttacgnggactatactacgtccgagtaaccggttccccgggacctaggacccgtatccgaaagggttccggcgcgggtccgggtntacgggactagttactttcactcctcaacntcagtcagcctgacgagtctagagtaggtggtacggtnttaacggtttactcgtcactagacttaagttacttaacgttacggtaaccctccgttaccggttacgcccgtttaacggtcccgtttaccggggaacggttaccggaacgtagggtaagaacgagttacccgtaagttaaccggtgg

SEQ ID NO: 437392 - DNA, 677 bp, Homo sapiens
  misc_feature: GZ8MTXP01DCSGE.13.38.D05.1.454.CMB.2.raw
  modified_base (279)..(279): a, c, t, g, unknown or other
  modified_base (307)..(307): a, c, t, g, unknown or other
  modified_base (531)..(531): a, c, t, g, unknown or other
  modified_base (580)..(580): a, c, t, g, unknown or other
  modified_base (645)..(645): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcggtggggggggcttgggtaagcccgggggtcctcgagactctcctgtgcaacctctggattctatttcnctgacgcctggtgagtcgtggggtcccnccgacgggtccgtacccggggaaggggcgtaggggtaggttgggggttcgggacccgttaagtttaaaaggggtaggaaacggacgaacgttgggtacgggaaacaacgtaacgaaccctaacgaggttcgtttaccccggagtaaaaaaacggggcctaaggtatttaccaacttaactcctacgaaagagatagaactaacgaaaagaatagaatatactanagtaacaaatagaaacgaaaccgtaaggaaaacgcgaaaggaccaacgnggacgttagtattacgacgtaccacgaagacgttaggaccaggtatgacgaagttcggccgacgngtacgtcgttacgtcggttcgggggaacccgg

SEQ ID NO: 437393 - DNA, 647 bp, Homo sapiens
  misc_feature: GZ8MTXP01CWQQ8.13.38.D05.1.454.CMB.2.raw
  modified_base (248)..(248): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatcgacccagtctccagactccctggctgtgtctcgtgggcgaggacgggccaccatccaactgacaagtccagccagtagttagttttanacagtcctacaaacaataacgtacttctagcttacggtaccagacaaacgaaaccgacggaacacgtccctactaagctcgtactactatttacgtggacagttactacggtaccggtacggttccccggggtacccctaggaccgtattcgaggtcgggacctaaggggccgggttggtacgggatacgtacttttcacctcctacaccgactcgagcacgtccgtgacgacggcgtaggaagtggtcggggtagttacgtagttttacttacgtacggtactaagtactaattaacttagttacgtcgtccgtcgttacgtcgttaccgttacggttcgggacgggttaacggttaccggtaagggtaccgaagtaacacggaacgtcgttcggtcg

SEQ ID NO: 437394 - DNA, 736 bp, Homo sapiens
  misc_feature: GZ8MTXP01DWGY4.13.38.D05.1.454.CMB.2.raw
  modified_base (681)..(681): a, c, t, g, unknown or other
  modified_base (692)..(692): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacgccagtcctccactcccaccctgtctgtcgtctcgtcggagacgaggtccaccatcacgttggtacggacaagtacaagaactagttcggactaacttacttaaagttgtatcagacaagagtacgaggtaccaaccgaccccgtaacctccgtagtactacgtaccgtaactactcctactttcgacacgtaggtacggactaccagttaccgaggttacgaggtacgacgtaaacgttagcgttacgtaacggtaaaccgttacgtttaaccctttaaccccgtacgtaacccgtacgttacgggtaaccggggttacctaacgtaccggttaccgtaaggttaaacgtttcgtttacggaaccgttaacttattaacgttaccgtaaaccgtaaacgttaccggtttaacccgttaccccgttaccccggtaccccggtacggtacggtaaacccgggaacggtaaaccggtaaacggtaataaaccgtaacgtaacggttacgtacgtttacggngtacgttaccncgttactaactctcgttctaccttccttaaccggttccctaacg

SEQ ID NO: 437395 - DNA, 581 bp, Homo sapiens
  misc_feature: GZ8MTXP01EKGK8.13.38.D05.1.454.CMB.2.raw
  modified_base (247)..(247): a, c, t, g, unknown or other
  modified_base (333)..(333): a, c, t, g, unknown or other
  modified_base (390)..(390): a, c, t, g, unknown or other
  modified_base (425)..(425): a, c, t, g, unknown or other
  modified_base (429)..(429): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagactccctggctgtgtctcgtgggcgaggacggccaccatcaactgacaagtccagccagtagttagttttaanacagacctaccaaactaaataagtaacttctagcttaggaccagacaagaaaccaggacacgcctacaagctgctactatttacgnggactactcgtacgtccggaacgtcccggggtacccctggacgtatcgaggtcgcgngggtcggtgcgggactagtcttcactctacactancgancacgcctgcgagtcagaagtgtcggggtagtacttaagtttactacgtgtacagtaacttaaattagttactacgtacctcgtcgttagtccttcgtacgttcgggacgggttacgaacggtaaggtggaacacgtacaacggtcgttggcg

SEQ ID NO: 437396 - DNA, 634 bp, Homo sapiens
  misc_feature: GZ8MTXP01AWJ8R.13.38.D05.1.454.CMB.2.raw
  modified_base (441)..(441): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatcgacccagtctccagacctccctggctgtgtctcgtggcgaggaggccacatcaactgacaagtccagcctagtagttgtttacacagcctaaccaaacaataacgtaacttctagcttacggtaccagacaagaaaccgaggacacgccctactaagctgtactctatttcgaggctatacgtacgaccggtacgtccgggtcccctaggaccgtattacgaggtaggctaacgggtcgggtagacgggactagttacctacgtaccttccgcaaaccgtnacgacgtacgacgccctagacggtagtcgtaagaagtcgtgggggtcgtaccttagttaactacgtcgtacgaacgtaataagttattacgtacgtccctccgtcggttagtcttaccgtacggttcccgggaaggttcggggaaccgtaaggggtacgtaacgtacgtaacccgaaaggtcgttgggtaacg

SEQ ID NO: 437397 - DNA, 648 bp, Homo sapiens
  misc_feature: GZ8MTXP01E1GEV.13.38.D05.1.454.CMB.2.raw
  modified_base (250)..(250): a, c, t, g, unknown or other
  modified_base (467)..(467): a, c, t, g, unknown or other
tcagtcacgtactacacgaccggtgctcgatttagtatctgatagttgggtttggggggagctacaaacaggcaggcagggggcagcaagatggtgttgcagacccaggtcttcattttctctgttgctctggatctctggtgcccgacgggggacatcgtgatgaccccagtcctccagactcccctggctgtgtctcgtgggcgagagggccaccatcaactgcaagtccagccagagttgtttttanacagcctaccaaacaaataaagaacttcttagcttggtaccagacagaaaaccaggacagcctcctaaagctgctactatttactgggctatcttaagtcccggggaaatcccgggggtcccccccctggaccgattcaggtcggcaaggtccggggtctaggggacaagtattcactctcaccatcagcagcctgcgaggctagaaagtatggggngtctagtttaattacgtgtacagaactaattaaattaataacggttaactcccgtacccggttacgggcttccgtaaccggttttcgggaccggggggttaacgggttaaccccgggaaaaagggggttcgggtaaacggaacgttaccaaaaaaacggtaaacccgttaagggttcgggg

SEQ ID NO: 437398 - DNA, 487 bp, Homo sapiens
  misc_feature: GZ8MTXP02HPQCK.13.38.D05.1.454.CMB.2.raw
  modified_base (351)..(351): a, c, t, g, unknown or other
  modified_base (365)..(365): a, c, t, g, unknown or other
  modified_base (425)..(425): a, c, t, g, unknown or other
tcagtcacgtactacacgaccggtgctcgatttagtatctgatagttgggtttgggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctcctaagctgctcatttactgggcatctatccggaatccgggcccctgaccgattcagtgcngcgggtctgggacngatttcactctcaccatcagcagcctgcaggctgaagatgtggcagtttatactgtcagnaatattatagtactctcgagctcacttcggcgtaggaccaaggtgagatcaaacgactgtcg

SEQ ID NO: 437399 - DNA, 498 bp, Homo sapiens
  misc_feature: GZ8MTXP02JW1FP.13.38.D05.1.454.CMB.2.raw
  modified_base (430)..(430): a, c, t, g, unknown or other
tcagtcacgtactacacgaccggtgctcgatttagtatctgatagttgggtttgggagctacaacaggcaggcagggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtcccctgaccgattcagtggcagcgggtctggggacagatttcactctcaccatcagcagcctgcaggctgaagatgtgcagttattactgtcaganatatatatactctcgacgctctacgtcgtcggacggacgaaggtaggagactacaacgaacgtacgtg

SEQ ID NO: 437400 - DNA, 503 bp, Homo sapiens
  misc_feature: GZ8MTXP02HDI13.13.38.D05.1.454.CMB.2.raw
  modified_base (280)..(280): a, c, t, g, unknown or other
  modified_base (309)..(309): a, c, t, g, unknown or other
  modified_base (484)..(484): a, c, t, g, unknown or other
  modified_base (490)..(490): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaataattatgtatattggtatcagcagctcccaggacgccccaaangctcatctatagaataatcagcggccctnacggggtccctgaccgattctctggctccccaagtctggcacctcacgcctcctggcccatccagtgggcctccggtcgaggatggaggctgattattactgtgcagcaagtcgggatgacagcctggagtggtcgtgttcggcgaggacagctcgaccgtcagtcagccaagcncgcccnggtcacgtctccg

SEQ ID NO: 437401 - DNA, 524 bp, Homo sapiens
  misc_feature: GZ8MTXP02HTICZ.13.38.D05.1.454.CMB.2.raw
  modified_base (356)..(356): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctcctaagctgctcattactgggcatctatccgggaatccggggtcccctgaccgattcagtcggcnggcggtctggggaccagatttcactctcaccatcagcagcctgcaggctgaagatgtggtctagtttatactgtcagactaatattatagtactctaccgagctctacgtttcggacggtacggaccgaaagggttggaagtacgtacgaaaacggactttaggtcgg

SEQ ID NO: 437402 - DNA, 515 bp, Homo sapiens
  misc_feature: GZ8MTXP02JRL02.13.38.D05.1.454.CMB.2.raw
  modified_base (236)..(236): a, c, t, g, unknown or other
  modified_base (310)..(310): a, c, t, g, unknown or other
  modified_base (357)..(357): a, c, t, g, unknown or other
  modified_base (413)..(413): a, c, t, g, unknown or other
  modified_base (457)..(457): a, c, t, g, unknown or other
  modified_base (492)..(492): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcagaaaccaggacagcctcctaagctgctcatttacngggcatctatccgggaatccggggtccccctgaccgattcagtggcngcgggtctgggacagatttcactctcaccatcagcagcctgcaggctagaagatgnggctagtttattactgtcagactaatattatagtactcctccgngactcgtacgttcggcggacggaccgaaggtaggngacgtacaacgtaacgtgaaagg

SEQ ID NO: 437403 - DNA, 514 bp, Homo sapiens
  misc_feature: GZ8MTXP02IG79A.13.38.D05.1.454.CMB.2.raw
  modified_base (256)..(256): a, c, t, g, unknown or other
tcagtcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtgggagacagagtcattatcacttgccgggcactcagtttgtggtaggtggttgtctggtntcagcaaaagccagggcaagcccctaaactcctgatctttgaggcgtctactttaggaacggggatctcacccaggttcagcggccagtggatcgtgggacagattcaccctcaccatacaacagcctgcagcctagaagactctgacaacttactactgtacaaacagtataattacttaattacacttttggactaggggaccaaagtgagatacaaagactgacggctacgcacaatctgtcttcacttctccgc

SEQ ID NO: 437404 - DNA, 494 bp, Homo sapiens
  misc_feature: GZ8MTXP02HUJAY.13.38.D05.1.454.CMB.2.raw
  modified_base (236)..(236): a, c, t, g, unknown or other
  modified_base (310)..(310): a, c, t, g, unknown or other
  modified_base (354)..(354): a, c, t, g, unknown or other
  modified_base (370)..(370): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcagaaaccaggacagcctcctaagctgctcatttacngggcatctatccggaatccggggcccctgaccgattcagtggcngcgggtctgggacagnttcactctcacatcagcagcctgcaggctgaagatgtggctagtttatactgtacagcaatattatagtactctcgagctctacgttcgcgaggaccgaaggtgagactacgaacgaacgtgtg

SEQ ID NO: 437405 - DNA, 550 bp, Homo sapiens
  misc_feature: GZ8MTXP02IP3E5.13.38.D05.1.454.CMB.2.raw
  modified_base (341)..(341): a, c, t, g, unknown or other
  modified_base (364)..(364): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagagtcagggcaagccccgaactcctgatctacggtacatccactttgcacagtggatcccatccaaggttcagtggcagtanatctggaacagtacttttacccncacccatcgaggggtctacagtcctagaagtattttgcgtacttactattgtacaaactagtacgtttaccttacctcccccggacgttccggccgtaaacgggacctaagggtaggaaaactacgaaagcgaaacgtggtacggcgtcgcaccaagtctcgttccttacacttccttcccgtacc

SEQ ID NO: 437406 - DNA, 497 bp, Homo sapiens
  misc_feature: GZ8MTXP02GDGLI.13.38.D05.1.454.CMB.2.raw
  modified_base (237)..(237): a, c, t, g, unknown or other
  modified_base (357)..(357): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtcccctgaccgattcagtgcngcgggtctgggacagatttcactctcaccatcagcagcctgcaggctgaagatgtggcagtttatactgtcagcaatattatagtactctcgaggctcactttcggcgaggaccaaggtgagactacaaacgactgtagg

SEQ ID NO: 437407 - DNA, 529 bp, Homo sapiens
  misc_feature: GZ8MTXP02JZYMV.13.38.D05.1.454.CMB.2.raw
  modified_base (362)..(362): a, c, t, g, unknown or other
  modified_base (498)..(498): a, c, t, g, unknown or other
  modified_base (528)..(528): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaatggtatcagcagaagtcaggcaagccccgaactcctgatctacggtacatccactttgcacagtgggatcccatccaaggttcagtggcagtagatctggaacagtatttacccncaccatcaggggtctaacagcctagaagtattttgacgtacttactattgtacaactagtacttaccttcgtcccccggtagttccggaccgaacgggacgaacggtagggaaactcgaagacgaactagtggacncgacaccaatctcgtctactactcttcccnc

SEQ ID NO: 437408 - DNA, 595 bp, Homo sapiens
  misc_feature: GZ8MTXP02JVFHC.13.38.D05.1.454.CMB.2.raw
  modified_base (198)..(198): a, c, t, g, unknown or other
  modified_base (232)..(232): a, c, t, g, unknown or other
  modified_base (280)..(280): a, c, t, g, unknown or other
  modified_base (553)..(553): a, c, t, g, unknown or other
tcagtcacgtactacacgaccggtgctcgatttagtatctgatagttgggtttgggggagtcagtctcagtcaggacacagcatcggacatgacgggtcccgctcagctcctgggctcctgctactctggctccgaggtgccagatgtgacatccagatgagccagtctccatccacctgtcctggcgtctctcgganacagggtcaccatcacttgtcggcaagtcagacnttggcaactcttaatggtatcagcagagtcaggcacgccccaactccngatctacgtacatccaactttcgcacacggtcgggactcccgatcccgtaaggttcaggtggcacgtagctacgaggaaacagtacttttaccccacaccatccgacggggtacctacgacgccgtagaagtattttagacgtactttattattcgtactaacgtagttactttaacccgttcccgttacccccgggtacgtttaccggaccgtaaacggggtaccgtaaggggtacggaaacgttacgaacggacgaaacgtcggcggtacncggaccaccgaatcgttcgtccttactacttccctccgtccc

SEQ ID NO: 437409 - DNA, 508 bp, Homo sapiens
  misc_feature: GZ8MTXP02J0UDK.13.38.D05.1.454.CMB.2.raw
  modified_base (345)..(345): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatccaaggttcagtggcagtagntctggaacagattttaccctcaccatcaggggtctacagcctgagattttgcgtacttactattgtcaacagagttaccttctcccccgacgttcggccaaggaccaaggtggaaaatcaagcgaactagtggctcgcacaatctgtcttcactcttccgacc

SEQ ID NO: 437410 - DNA, 550 bp, Homo sapiens
  misc_feature: GZ8MTXP02GZX8J.13.38.D05.1.454.CMB.2.raw
  modified_base (343)..(343): a, c, t, g, unknown or other
  modified_base (364)..(364): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgcacagtggatcccatccaaggttcagtggcagtagntctggaacagtactttacccncaccatcgaggggtctacgagcctagaacgtattttgacgtacttactattcgtacaacagtacgtttacccttccgtacccccggtagttccggaccgaacgggaacccgtaagggtaggaaactacgaaagacgaaactggtacgggctacgcaccaagtctcgttctacacttcctcccgtcc

SEQ ID NO: 437411 - DNA, 566 bp, Homo sapiens
  misc_feature: GZ8MTXP02JWZYI.13.38.D05.1.454.CMB.2.raw
  modified_base (344)..(344): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatcccatccaaggttcagtggcagtagntcgtaggaacagtactttaccctcaccatcgaggggtctacagcctagaagtattttgcgtacttactattgtacaactagtacgtttacccttcctcccccgggtacgttccggaccgtaacgggaccgtaaacgggtaggaaaactaccgaaaggaccgaaacgtaggtacggccgtcgaccacctaactcgtcgttcttctacttccgttcccgacccg

SEQ ID NO: 437412 - DNA, 507 bp, Homo sapiens
  misc_feature: GZ8MTXP02JP9F5.13.38.D05.1.454.CMB.2.raw
  modified_base (236)..(236): a, c, t, g, unknown or other
  modified_base (311)..(311): a, c, t, g, unknown or other
  modified_base (355)..(355): a, c, t, g, unknown or other
  modified_base (409)..(409): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttacngggcatctatccggaatccggggtcccctgaccgattcagtgcngcgggtctgggacagatttcactctcacccatcagcagcctgcaggctgaaagntgtggctagtttatactgtcagcaatatatagtactctcgagctctacgttcggcggtaggaccgaaggtggaacgatacgaaacgtaacgtgtacgg

SEQ ID NO: 437413 - DNA, 508 bp, Homo sapiens
  misc_feature: GZ8MTXP02F8AIY.13.38.D05.1.454.CMB.2.raw
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctccatcgcttctctggctccatccttgggaacaaagctgcccttatcatcacggggcccagcagaagatgaatctgattattactgtgttctttatatggtatgcattctgctgtgttcggaggaggcacccggctcgaccgtccgtcggtcacgcccaaggctcgcccc

SEQ ID NO: 437414 - DNA, 487 bp, Homo sapiens
  misc_feature: GZ8MTXP02FO2GG.13.38.D05.1.454.CMB.2.raw
  modified_base (236)..(236): a, c, t, g, unknown or other
  modified_base (353)..(353): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctctaagctgctcattactgggcatctatccggaatccggggtcccctgaccgatcagtggcngcggtctggacagatttcactctcaccatcagcagcctgcaggctgaagatgtggctagtttatactgtcagcaatattatagtactctcgagctcacttcgcgaggacaaggtgagactacaaacgactagtg

SEQ ID NO: 437415 - DNA, 548 bp, Homo sapiens
  misc_feature: GZ8MTXP02F1VT3.13.38.D05.1.454.CMB.2.raw
  modified_base (402)..(402): a, c, t, g, unknown or other
tcagtcacgtactacacgaccggtgctcgatttagtatctgatagttgggtttgggggagtcagtctcagtcaggacacagcatggacatgagggtccccgctcagcccctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaacgccccgaactcctgatctacggtacatccactttgcacagtcggatccatcaaggttcagtggacagtagatctaggaaacagtactttacccacaccatacgtaggggtctacgacgcctagaagtnttttgacgtacttactattagtacaaactagtacttaccttccgtccccggacgttcggaccgtacgggtaacgaaggtaggaaatacgaacgtacgaacgtggtacggctacgcacctactcgtcgtctctatccttcccgctac

SEQ ID NO: 437416 - DNA, 531 bp, Homo sapiens
  misc_feature: GZ8MTXP02JFOKF.13.38.D05.1.454.CMB.2.raw
  modified_base (343)..(343): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacgtacatccactttgcacagtggatccatcccaaggttcagtggcagtagntctaggaacagtactttacccncacatcgagggtctacagcctagagtatttgacgtacttactattgtacaaactagtacgttaccttccgtaccccggtacgttccggaccgaaggaccgaaggtagaaaatacgaaagacgaacgtagtggctacgcactaatactcgtcttcactccttccacc

SEQ ID NO: 437417 - DNA, 551 bp, Homo sapiens
  misc_feature: GZ8MTXP02IMU2L.13.38.D05.1.454.CMB.2.raw
  modified_base (357)..(357): a, c, t, g, unknown or other
tcagtcacgtactacacgaccggtgctcgatttagtatctgatagttgggtttggggagtcagtctcagtcaggacacagcatggacatgagggtcccgctcagctcctggggctcctgctactctggctccgaggtgccagatgtgacatccagatgagccagtctccatccaccctttctgcgtctctcggagacagggtcaccatcacttgtcgggcaagtcagaacattggcaactcttaaatggtatcagcagaagtcagggcaagccccgaacctcctgatctacggtacatcactttgcacagtggatccatcaaggttcagtggcagtagatctgacagactttacccnaccatcagggtctacagcctgaagtattttgcgtattactattgtcaaacagtacgttacccttctacccccggacgttccggtaccgaagggaacccgaaggtaggaaaagtacgaaacgacgaacctaggttacggactcggaccacctaactcttcggttactttcctaactcctttccccggaccttaac

SEQ ID NO: 437418 - DNA, 532 bp, Homo sapiens
  misc_feature: GZ8MTXP02GXRDH.13.38.D05.1.454.CMB.2.raw
  modified_base (312)..(312): a, c, t, g, unknown or other
  modified_base (360)..(360): a, c, t, g, unknown or other
  modified_base (420)..(420): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctctaagctgctcatttacngggcatctatccgggaatccggggtcccctgaccgtattccagtggcnggcgggtctgggacagtatttcactctcaccatcagcagccctgcaggctagaaagatgnggactagtttactactgtcagactaattattatagtacctcctccgagtcctcgtacttcgggcgaagggtaccgaaggttggaacgtactacgaaaacgtacgtggtacgg

SEQ ID NO: 437419 - DNA, 498 bp, Homo sapiens
  misc_feature: GZ8MTXP02JBLG4.13.38.D05.1.454.CMB.2.raw
  modified_base (355)..(355): a, c, t, g, unknown or other
  modified_base (410)..(410): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctcaacaataagaactctagcttggtaccagcagaaaccaggacagcctcctaagctgctcattactgggcatctatccgggaatccggggtccccctgacccgattcagtggcngcgggtctgggacagatttcactctcaccatcagcagcctgcaggctgaagatgnggcagtttatactgtcagctaatattatagtactctcgaggctcactttcgcggaggaccaaggtcgaggactcaaacgactagtcgg

SEQ ID NO: 437420 - DNA, 500 bp, Homo sapiens
  misc_feature: GZ8MTXP02JE50G.13.38.D05.1.454.CMB.2.raw
  modified_base (237)..(237): a, c, t, g, unknown or other
  modified_base (311)..(311): a, c, t, g, unknown or other
  modified_base (357)..(357): a, c, t, g, unknown or other
  modified_base (436)..(436): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcagaaaccaggacagcctcctaagctgctcatttacngggcatctatccgggaatccggggtcccctgaccgattcagtggcngcgggtctggggacagatttcactctcaccatcagcagcctgcaggctgaagatgtggcagtttatactgtcagcaatnttatagtactctcgagctcacttcggcgtaggaccgaaggtggagactcgaaacgactagtcgg

SEQ ID NO: 437421 - DNA, 554 bp, Homo sapiens
  misc_feature: GZ8MTXP02H91G8.13.38.D05.1.454.CMB.2.raw
  modified_base (318)..(318): a, c, t, g, unknown or other
  modified_base (345)..(345): a, c, t, g, unknown or other
  modified_base (377)..(377): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttatacagctccgacaataggaactacttagcttggtaaccaaacagaaaaccaggacacgcctaccgaagtttactctttacgnggctcgtacccgggatcccggggtccngaccgatcagtgcaggcgggtctgggacagtntttcactctcaccatcagcagcccttagacggtctagaaagatggtggctagtttattactgtacagtactaatattatagtactctcgacgtctactacgtttcggacggagggaccgaagggtaggaacgtataccgaaaacgaacgtggtcggactaggaccacctattcgtcg

SEQ ID NO: 437422 - DNA, 528 bp, Homo sapiens
  misc_feature: GZ8MTXP02GSOV2.13.38.D05.1.454.CMB.2.raw
  modified_base (344)..(344): a, c, t, g, unknown or other
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatccatccaaggttcagtgcagtagntctggaaacagtacttttacccncaccatcaggggtctaacagcctagaagtatttcgactacttactattgtacaacagtagttaccttctacccccgtagtcggtaccgaacggacgaacggtagaaagtacaaacgacgaacgtagtagcgtacgcacaagtctctctctactcctccgtc

SEQ ID NO: 437423 - DNA, 636 bp, Homo sapiens
  misc_feature: GZ8MTXP02JV1CL.13.38.D05.1.454.CMB.2.raw
  modified_base (341)..(341): a, c, t, g, unknown or other
  modified_base (365)..(365): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagagtcaggcaagccccgaactcctgatctacggtacatccactttgcacagtggatcccatcccaaggttcaggtgcagtanatcgtaggaacagtactttacccncaccatcgaggggtctacgagcctagagtattttgacgtacttacgttattcgtactaacgagttacgtttacccttaccgttaccccccgggtacgtttccgggacccgtaaacggggtaacccgtaaaggggttacggaaaacgttaccggaaaacggtaccggtaaacccgttagggtacggggtccgttacgggacccgtaaacccctaagttacccgtttcgggttacccttttaccgaacctttcccgttccccggttaaccccg

SEQ ID NO: 437424 - DNA, 509 bp, Homo sapiens
  misc_feature: GZ8MTXP02IQP6I.13.38.D05.1.454.CMB.2.raw
  modified_base (375)..(375): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctctctggggtcctcatcgctctctgctcatcctggaacaagctgcccttancatcacgggggcccaggcagaagatgaatctgattattactgttgttcttatatgggtatgctatttctgcttgtgtttcggaggtaggcacccgggctcgacccgtcgtcggtcacgcccaaggcctcgcccc

SEQ ID NO: 437425 - DNA, 507 bp, Homo sapiens
  misc_feature: GZ8MTXP02JU0KA.13.38.D05.1.454.CMB.2.raw
  modified_base (237)..(237): a, c, t, g, unknown or other
  modified_base (356)..(356): a, c, t, g, unknown or other
  modified_base (410)..(410): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagacttctagcttggtaccagcagaaaccaggacagcctcctaagctgctcatttactgggcatctatccgggaatccggggtcccctgaccgattcagtggcnggcgggtctgggacagatttcactctcaccatcagcagcctgcaggctgaaagntgtggcagtttatactgtcagcaatatatagtactctccgaggctcacgtttcgcggtaggaccgaaaggtggaacgatacgaaacgtaactggtcg

SEQ ID NO: 437426 - DNA, 644 bp, Homo sapiens
  misc_feature: GZ8MTXP02JKXS5.13.38.D05.1.454.CMB.2.raw
  modified_base (246)..(246): a, c, t, g, unknown or other
  modified_base (333)..(333): a, c, t, g, unknown or other
  modified_base (400)..(400): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacgggacatcgtgatcgacccagtctccagacctcccgtggctgtgtctcgtgggcgagacggccacatcaactgacaagtccagccagtagttgttttaanacagtcctaccaaacaataagtaacttcttagcttaggtaccagacaacgaaaccaggacagccctactaagctgctctatttacgnggctatctacgtaccgggacgtcccggggtccccctgaccgtattcgagtcggcgacgggtcgggtntacgggacagtactttccactcctaccacctactcgagccacgccctgacgacggtctaggaaagtgttggtacgggtacttaagttttacttaacgttggtaccgaagtacctaaattaatttacgttaaacgtacccttcccgtaccggacgtccttaccggttacgtttaccggggacggtaacggggaaccgtaaggggttcggaaacgtacgtaaccgaaaaccggtaacgtaggtcgg

SEQ ID NO: 437427 - DNA, 589 bp, Homo sapiens
  misc_feature: GZ8MTXP02I8EPL.13.38.D05.1.454.CMB.2.raw
tcagtcacgtactacacgaccggtgctcgatttagtatctgatagttgggtttggggagtcagtctcagtcaggacacagcatggacatgagggtccccgctcagcccctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaacggttcagtggctagtagatcgtaggaactagttactttaccctacaacctactacgaggggtcctaacgacgtcctagaagttagtttgacgtacttactattcgtacaactagttacgttacccttccgtaccccggtacgttccggacgaacggaaccgaggtaacgggaaactacgaaacgtacgaaacgtggtacggtcgtacgacctaaccgtactcgttacgttcttacctacgtccctttacccgccttaacg

SEQ ID NO: 437428 - DNA, 551 bp, Homo sapiens
  misc_feature: GZ8MTXP02GN9CY.13.38.D05.1.454.CMB.2.raw
  modified_base (486)..(486): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctatttaaaggtgtccagtgtgaggtgcaagtggtggagtcgtggggggggcttgggttaagcctgggggtccctcagactctcctgtgcaacctctggattcattttctctgacgcctggttgagctgggtccgccaggctcccgggagggctggagtgggttggccgtattaaaggagaagacatggtcggacaacagactacagtgttcccgtgaaaggcagattcactatctcaagagatgactacaaaagaatgatatatctagacaaatgaaacaacctagaaaagcgaaggacacgaggactagtattacgngtaaccacagatcgggaccagactgactaaaagcggaccgacgacgagttcgactacgtcggggg

SEQ ID NO: 437429 - DNA, 586 bp, Homo sapiens
  misc_feature: GZ8MTXP02F9SKL.13.38.D05.1.454.CMB.2.raw
  modified_base (237)..(237): a, c, t, g, unknown or other
  modified_base (319)..(319): a, c, t, g, unknown or other
  modified_base (374)..(374): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttanacagctaccaaacaataagaacttctagcttaggtaccagacaagaaaccaggacagcctacctaagctgctctatttacgnggcatctaagtccgggaactccggggtcccctagaccgtattccgaggtcggcgnggcgggtctaggggacagtactttccaccttctaccaccatacgaagcgacgcccgtgaccgaagggtcctaaggaaacgtagttgggtacggtacgttaaggttttacttaacgtgttacgaatactaaattattaatacgtacctccgtacgagtactcgtacgttcggacgaggacgtaaggtagacgacgtacaaacgtactggtacg

SEQ ID NO: 437430 - DNA, 577 bp, Homo sapiens
  misc_feature: GZ8MTXP02IRP22.13.38.D05.1.454.CMB.2.raw
  modified_base (345)..(345): a, c, t, g, unknown or other
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaatctttaaattggtatcagcagaagtcagggcaacgccccgaactcctgatctacggtacatccactttgcacagtggactccatccaaggttcagtggcagtagntctaggaactagtacttttacccncaacctatcgaggggtctacgagcctagaatagtttcgacgtacttactattgtacaaactagtacgtttacccttccgtcccccggtagttcccggaccgtaaacggggaacccgtaaagggtacgaaaacgttacgaaaacgcggaaaactcggttacggcttacgccaacctaacgtcttacgttcttactctcctttcccgacc

SEQ ID NO: 437431 - DNA, 535 bp, Homo sapiens
  misc_feature: GZ8MTXP02HF17A.13.38.D05.1.454.CMB.2.raw
  modified_base (386)..(386): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaaacactcgctcttctggggtccctccatcgcttctctggctccactccttgggaacaaagctgcccttancatcgacgggggcccaggcagaagatgaatctagattattacttgtgtttctttatagtgggtagtgcctatttctgtctgtgtttcggaggtaggccgacccggctcggaccgtccgtcggtcacggcccaacggtcctacgcccccg

SEQ ID NO: 437432 - DNA, 539 bp, Homo sapiens
  misc_feature: GZ8MTXP02GRIR5.13.38.D05.1.454.CMB.2.raw
  modified_base (237)..(237): a, c, t, g, unknown or other
  modified_base (308)..(308): a, c, t, g, unknown or other
  modified_base (351)..(351): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctcaacaataagaacttctagcttggtaccagcagaaaccaggacagcctctaagctgctcattacngggcatctatccggaatccgggtcccctgaccattcagtggcnggcgggtctgggacagatttcactctcaccatcagcagcctgcaggctagaagatggtgctagtttatactgtacagactaaatatttaatacgtaccttaccgtaccggaggtcctactacgtttaccgggaccggtaaggggacctaaggggtcgtagacgtaccgaaaacggtacgtaggtacgg

SEQ ID NO: 437433 - DNA, 535 bp, Homo sapiens
  misc_feature: GZ8MTXP02ICZLB.13.38.D05.1.454.CMB.2.raw
  modified_base (237)..(237): a, c, t, g, unknown or other
  modified_base (312)..(312): a, c, t, g, unknown or other
  modified_base (419)..(419): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttcttagcttggtaccagcagaaaccaggacagcctctaagctgctcatttacngggctatctagtccgggaatccggggtccccctgacccgattcagtggcaggcgggtctggggacagtatttcactctcaccatcagcagcctgcaggctagaaagntgtggtctagtttatactgtacagactaattattatagtactccgtcgagtctacgtacgtttcgggacgggtaacggaccgaaagggtgaagtactacgaaaccgacttaggcgg

SEQ ID NO: 437434 - DNA, 548 bp, Homo sapiens
  misc_feature: GZ8MTXP02GI7OY.13.38.D05.1.454.CMB.2.raw
  modified_base (368)..(368): a, c, t, g, unknown or other
  modified_base (396)..(396): a, c, t, g, unknown or other
  modified_base (418)..(418): a, c, t, g, unknown or other
tcagtcacgtactacacgaccggtgctcgatttagtatctgatagttgggtttggggctgggagaggagccccagccttgggattcccaagtgttttcattcagtgatcagcactgaacacagaggactcaccatggagtttgggctgagctggattttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaggggctgggagtgcgtctctttattatagtagtgtagtacatactcgnagactccgtgaggggccattcaacatcnccagagacaaatccaaagaacncgactgtttacttacaaatcgaaacagccctagaacgacgtccgaatgacgacggccgtgtattacgtgtgacggagacgaagcgggggaccccaaggtaacgttacaacggcttaagcggtacgtccgg

SEQ ID NO: 437435 - DNA, 618 bp, Homo sapiens
  misc_feature: GZ8MTXP02H1LCH.13.38.D05.1.454.CMB.2.raw
  modified_base (388)..(388): a, c, t, g, unknown or other
  modified_base (426)..(426): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccggggtgccagatgtgacatccagatgagccagtctccatccacctgtctgcgtctctcggagacagggtcaccatcacttgcgggcaagtcagaactattggacaacttactttaaattggtatcagcataagtcgaggacaacgccccgaacctcctgactctacgtacatcctaactttgacactagtcgggactcccatcgtaacggttcagtcggactagtagatcgtaggaactacgtacttttacccncacctatcgtagggtctacgacgtacctagtaaagttntttacgacgtaactttactatttacgtaactaaacgtacgttaccgtttacccttccgttacccccggacgtttaccggaccgtaaacgggaccgtaaacggtagaaacgtaacgaacgacgtaaacgtggttacggctacgacctacctaacgtctcgttacgttcctaactcccgtttacccgtacctcg

SEQ ID NO: 437436 - DNA, 591 bp, Homo sapiens
  misc_feature: GZ8MTXP02F8GIW.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggttaaggcccgggggtcctcagactctcctgtgcaacctctggattcattttctctgacgcctggttgagctgggtccgccaggctcccgggagggctgggagtggggttggccgtagttaaaggtagaagacagtggtcggacaacagacctacagtgttcccgtagaaaggcagattcactatctacaagagatgactacaaaaagaatgaatatatctagacaaataagaaacaaacctaagaaaagaacgaacggaacgaacgacggacgtagtagttaactacgtaccaacaacgagtaggaccgagacgagacgaaagaggaaccgacgacgacggtacgtacgtacgtacgggaccgggg

SEQ ID NO: 437437 - DNA, 579 bp, Homo sapiens
  misc_feature: GZ8MTXP02GGPIO.13.38.D05.1.454.CMB.2.raw
  modified_base (191)..(191): a, c, t, g, unknown or other
  modified_base (281)..(281): a, c, t, g, unknown or other
  modified_base (291)..(291): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaacatcggaataattatgtatattggtatcagcagctccaggaaccgccccaaangctcatctanaggaataatcagccggccctcgacggggtccctggaccgtattctctggcctcccaagtcctggcacctcacgccctccctggccatccgaggtcgggcctcccgggtcgaggacgtggacggctagactttattacgtgtcgcagcagtggggatgacgagccgtggacggttggggttccgggttggttcggggcggggaacggggaccgaacggcgtacggaccgttccgtacggtccgacggcccgaaggccgtccggcccccgtcggtccaccgtcgttcccg

SEQ ID NO: 437438 - DNA, 540 bp, Homo sapiens
  misc_feature: GZ8MTXP02IK3EB.13.38.D05.1.454.CMB.2.raw
  modified_base (340)..(340): a, c, t, g, unknown or other
  modified_base (362)..(362): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatccatcaaggttcagtgcagtanatctggaacagtacttttaccncaccatcaggggtctacagcctgaacgtattttgcgtacttacttaattgtacaaactagtagttacccttacctcccccggtagttccggccgaaacgggaccgaaaggtgggaaaatccgaaaagacgaaacgtgtacggcgtacgcaccaagtctcgtacttctattccttctcg

SEQ ID NO: 437439 - DNA, 506 bp, Homo sapiens
  misc_feature: GZ8MTXP02JEOTB.13.38.D05.1.454.CMB.2.raw
  modified_base (358)..(358): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctcctaaagctgctcatttactgggcatctatccggaatccggggtccccctgaccgattcagtggcngggggtctggggacagatttcactctcacatcagcagcctgcaggctgaagatgtggctagtttatactgtcagcaatattatagtactcctcgaggctcaactttcggcggacggaccaagggtgagactacaaacgactcgtgacg

SEQ ID NO: 437440 - DNA, 603 bp, Homo sapiens
  misc_feature: GZ8MTXP02GWTXP.13.38.D05.1.454.CMB.2.raw
  modified_base (331)..(331): a, c, t, g, unknown or other
  modified_base (389)..(389): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaaacaataaagtaacttcttagtcttggtaccagacaagaaaccgaggaacacgaccctacctaagctgactctaatttacgngggcacttctaacgtccgggaacgtcccgggtcccctagaccgtattcgaggtcgacngggcggtcgtagggacagtatttcgactctaccacatccgagcacgccctgacgaggctaggaaagtagtggtacggtacgttagtttaacttactacggttacaagtactaaaatttattaacgttacgtacccttaccgaccggtacggcttacgtaccggttcggacggaacggacgtaagggtgaacgactaacgaacgaagttcggacg

SEQ ID NO: 437441 - DNA, 501 bp, Homo sapiens
  misc_feature: GZ8MTXP02IBPTN.13.38.D05.1.454.CMB.2.raw
  modified_base (343)..(343): a, c, t, g, unknown or other
  modified_base (349)..(349): a, c, t, g, unknown or other
  modified_base (358)..(358): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttcttagcttggtaccagcagaaaccaggacagcctcctaagctgctcatttactgggcatctatccggaatccggggtccccngaccgnttcagtgcnggcgggtctggggacagtatttcactctcacatcagcagcctgcagctagaagatgtggctagtttatactgtctagcaatattatagtactctcgagctcacttcggcgtaggaccgaaggtgagactacaaacgactgtcg

SEQ ID NO: 437442 - DNA, 522 bp, Homo sapiens
  misc_feature: GZ8MTXP02G0YJK.13.38.D05.1.454.CMB.2.raw
  modified_base (238)..(238): a, c, t, g, unknown or other
  modified_base (360)..(360): a, c, t, g, unknown or other
  modified_base (395)..(395): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttggtaccagcaagaaaccaggacagcctcctaagctgctcattactgggcatctagtccgggaatccggggtcccctgaccgattcagtgcnggcgggtctgggacagatttcactctcaccatcancagcctgcaggctagaagatgtggctagtttatactgtcagtcaaattattatagtactccgtacgaggtctacgacgtttcggacggtaggaaccgaaggtgaagactacgaaacgaactgtacgg

SEQ ID NO: 437443 - DNA, 518 bp, Homo sapiens
  misc_feature: GZ8MTXP02GUT26.13.38.D05.1.454.CMB.2.raw
  modified_base (238)..(238): a, c, t, g, unknown or other
  modified_base (311)..(311): a, c, t, g, unknown or other
  modified_base (359)..(359): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttctagcttggtaccagcagaaaccaggacagcctctaagctgctcatttacngggcatctatccgggaatccggggtcccctgaccgtattcgagtggcnggcgggtctggggacagtatttcactctcaccatcagcagcctgcaggctagaagatgtggtctagtttattactgtacagtacaatattatagtctctacgagtctcacgttcgacggacggacgaaggtcgacgtacgacgaaacgacgtagtacgg

SEQ ID NO: 437444 - DNA, 555 bp, Homo sapiens
  misc_feature: GZ8MTXP02FUJNU.13.38.D05.1.454.CMB.2.raw
  modified_base (283)..(283): a, c, t, g, unknown or other
  modified_base (365)..(365): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcagggcaagccccgaactccngatctacggtacatccactttgcacagtggatcccgatccaaaggttcagtggcagtagatctggaaacagtattttacccncaccatcaggggtctacagcctagaaacgtattttagcgtaacttacttaattcggtactaaacgagtacgttaaaccctttccgtaccccccgggtacgttcgtcccgaaacgggaacccgaaggtacggaaaactacgaagacgaactagtagcgtacgcaccaatcctgtctctactccgtacctcc

SEQ ID NO: 437445 - DNA, 534 bp, Homo sapiens
  misc_feature: GZ8MTXP02GCSB3.13.38.D05.1.454.CMB.2.raw
  modified_base (364)..(364): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaactcctgatctacggtacatccactttgcacagtggatccatccaaggttcagtggcagtagatctggaaacagattttaccctnaccatcaggggtctacagcctgaagtattttgcgtacttactaattgtacaaactagtacgttaaccttcctcccccggacgtttccggaccgaaacgggaccgaaacgggtaggaaaagtacgaaagacgaaactgtggctgcacaatctgtcttctactctccgtacc

SEQ ID NO: 437446 - DNA, 575 bp, Homo sapiens
  misc_feature: GZ8MTXP02ICYB0.13.38.D05.1.454.CMB.2.raw
  modified_base (287)..(287): a, c, t, g, unknown or other
  modified_base (344)..(344): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaagccccgaacctccngatctacggtacatccactttgcacagtggatccatccaaggttcagtggcagtagntctggaactagactttacccncaccatcagggtctacagcctgaagtattttgcgtacttactattgtacaacgtagtacgttaccttcctccccccggagtttccggacctaaacgggaccgtaaaggtacggaaaacttacgaaaaggtaccgaaaccgttggtacggtccgtacggcacccgtaagttccctacggtttccttcgtactttcccttaccccgtacccc

SEQ ID NO: 437447 - DNA, 498 bp, Homo sapiens
  misc_feature: GZ8MTXP02FLCNI.13.38.D05.1.454.CMB.2.raw
  modified_base (358)..(358): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaactcttagcttggtaccagcagaaaccaggacagcctcctaagctgctcatttactgggcatctatccgggaatccggggtcccctgaccgattcagtggcngcgggtctgggacagatttcactctcaccatcagcagcctgcaggctgaagatgtggctagtttattactgtcagcaatatatagtactctcgagctcacttcggcggaggaccaaggtgagactacgaaacgactgtcg

SEQ ID NO: 437448 - DNA, 614 bp, Homo sapiens
  misc_feature: GZ8MTXP02HHLAI.13.38.D05.1.454.CMB.2.raw
  modified_base (345)..(345): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaactctttaaatggtaatcagcagaagtcagggcaacgccccgaacctctgactctacggtacatccactttgcacagtggactccatccaagttcagtgcagtagntcgtaggaactagtactttacccactacctagtacgacggggtctacgagtacctagaagtattttcgacgtacttactattgtacaactagtacttacccgttaccgtaccccggtaccgttacggacccgtaaacgggaacccgtaaagggtaacggaaacgttaacgaaacggtacggtaaaaccgttggtacggaccgttcggacctaaccgtaacgttccgttacgtttaccttcctaacgtttcccgtttaccccgtaacccg

SEQ ID NO: 437449 - DNA, 530 bp, Homo sapiens
  misc_feature: GZ8MTXP02F61LD.13.38.D05.1.454.CMB.2.raw
  modified_base (318)..(318): a, c, t, g, unknown or other
  modified_base (366)..(366): a, c, t, g, unknown or other
  modified_base (398)..(398): a, c, t, g, unknown or other
  modified_base (402)..(402): a, c, t, g, unknown or other
  modified_base (405)..(405): a, c, t, g, unknown or other
  modified_base (423)..(423): a, c, t, g, unknown or other
  modified_base (446)..(446): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaaacaaataagaacttcttagcttggtaccagcaagaaaccaggacagcctcctaagctgctcatttacngggcatctagtccggaatccggggtcccctgaccgattcgagtcggcnggcgggtctgggacagtatttcactctcaccntcancancctgcgagctgaagatgnggtactagtttatacgtgtcagntaatattatacgtactccgtcgagtcctactacgttcggacggacggaacgaaggtgaacgactacgaaacgtaacgtgtacgg

SEQ ID NO: 437450 - DNA, 520 bp, Homo sapiens
  misc_feature: GZ8MTXP02H4NC8.13.38.D05.1.454.CMB.2.raw
tcagtcacgtactacacgaccggtgctcgatttagtatctgatagttgggtttggggtggaagcctgggaacacttagccttcatgagtgtccccaccatggcctggatgatgcttctcctcggactccttgcttatggatcaggagtggattctcagactgtggtgacccaggagccatcgttctcagtgtctcctggaggacagtcacactcacttgtgcttgagatacggctcagttctctagtagttactaccccagctggtaccaacagaccccaggccaggctccgcgcacgctcatctacaacacaaacactcgctcttctcggggtcctccatcgcttctctcggctccatccttggggaacaaaagctgcccttactcatcgacgggggcccaggcagaagatgaatctgattattacttgtgttctttagtatggtatgctatttctgcttgtagtttcgggagacggcaccggctcgaccgtcctcggtcacgccaacggctcgacccc

SEQ ID NO: 437451 - DNA, 564 bp, Homo sapiens
  misc_feature: GZ8MTXP02GG1JZ.13.38.D05.1.454.CMB.2.raw
  modified_base (238)..(238): a, c, t, g, unknown or other
  modified_base (320)..(320): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgtttanacagctaccaacaataagaacttcttagcttggtaccagcaagaaaccaggacagcctacctaagctagctactatttacgngggcatctagtccgggaacgttccggggtcccctgacccgtattccgaggtggcgaggccgggtcgtaggggacagtactttccactcctcaccatcagcagccctgcgaggctagaaagtagtggtaggtactagtttactactgtacagactaaattacttatacgtactccgtaccgaggtctcgtacgttcgggacggacgggaacgaagggtcgacggactaacgaaacgacgtggtag

SEQ ID NO: 437452 - DNA, 536 bp, Homo sapiens
  misc_feature: GZ8MTXP02FIDIN.13.38.D05.1.454.CMB.2.raw
  modified_base (510)..(510): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatccaaggttcagtggcagtagatctggaaacagattttaccctcaccatcaggggtctacagccctgaagattttgcgacttactattgtcaacagtagttaacccttctcccccggaacgttcggtccgaacgggaaccgaaggtacggaaagtacgaaagcgaaactgtaggcgtacgcaaccntactcgtcttctactcttccctaccc

SEQ ID NO: 437453 - DNA, 553 bp, Homo sapiens
  misc_feature: GZ8MTXP02HSP71.13.38.D05.1.454.CMB.2.raw
  modified_base (344)..(344): a, c, t, g, unknown or other
  modified_base (368)..(368): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggcaagccccgaactcctgactctacggtacatccactttgcacagtggatccatccaaggttcagtggcagtagntcgtaggaactagtacttttaccncaaccatcgaggggtctaacgagtccctagaagtatttcgacgtacttactattgtactaaactagtacgtttaccttccgtacccccggtacgtccggtaccgaacgggaaccgaaggtacgaaaatcgaaacggacgaaactggtacggcgtacgcacaagtctcgtctctactcttcccgtc

SEQ ID NO: 437454 - DNA, 509 bp, Homo sapiens
  misc_feature: GZ8MTXP02GD7EA.13.38.D05.1.454.CMB.2.raw
  modified_base (237)..(237): a, c, t, g, unknown or other
  modified_base (355)..(355): a, c, t, g, unknown or other
  modified_base (408)..(408): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgttttanacagctccaacaataagaactcttagcttggtaccagcagaaaccaggacagcctcctaagctgctcattactgggcatctatccggaatccggggtcccctgaccgattcagtggcngcgggtctgggacagatttcactctcacatcagcagcctgcagctgaagatgnggctagtttatactgtcagcaatattaatagtactcctcgaggcctcacgtttcggacggacggaccaaggtcggaagacgtacaaaacggactggtacgg

SEQ ID NO: 437455 - DNA, 532 bp, Homo sapiens
  misc_feature: GZ8MTXP02FZW1J.13.38.D05.1.454.CMB.2.raw
  modified_base (345)..(345): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaactcctgatctacggtacatccactttgcacagtgggatcccatccaaggttcagtggcagtagntctggaacagtatttacccncaccatcaggggtctacagcctagaagtatttgcgtacttactattgtcaactagagttacccttctacccccggacgttcggccgtaacgggaccgaaggtaggaaagtacgaaagacgaacgtagtcggcgtgcaccaagtactcgtctctactccttccgtacc

SEQ ID NO: 437456 - DNA, 522 bp, Homo sapiens
  misc_feature: GZ8MTXP02GL3HB.13.38.D05.1.454.CMB.2.raw
  modified_base (342)..(342): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgcatccagatgagccagtctccatccaccctgtctgcgtctctcggagacagggtcaccatcacttgtcgggcaagtcagaacattggcaactctttaaattggtatcagcagaagtcaggcaagccccgaacctcctgatctacggtacatccactttgcacagtgggatcccatccaagttcagtgcagtagntctggaacagacttttacccaccatcaggggtctacagccctgaagacttttgcgtacttactattgtcaaacagtagttaccttccgtcccccggacgttcggaccgtaacgggacaaggtaggaaatacgaacgacgaactgtaggctcgcacatctcgtcttcatccttccgcctac

SEQ ID NO: 437457 - DNA, 570 bp, Homo sapiens
  misc_feature: GZ8MTXP02GJ5CV.13.38.D05.1.454.CMB.2.raw
  modified_base (343)..(343): a, c, t, g, unknown or other
  modified_base (345)..(345): a, c, t, g, unknown or other
  modified_base (364)..(364): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatcccatccaaggttcagtgcagtagntnaggaacagtactttacccncaccatcgaggggtctacagcctagaagtattttgacgtactttactagttgaccaacgtagtacgtttacccttccgtaccccccggtacggttccggaccgaacggggaccgtaaacgggtacggaaaacgtacgaaacggacgtaaacgtacgtacggccgtacgaccaccaatcgtagtccttcaactttccgtcccgtacc

SEQ ID NO: 437458 - DNA, 496 bp, Homo sapiens
  misc_feature: GZ8MTXP02J1XBX.13.38.D05.1.454.CMB.2.raw
  modified_base (237)..(237): a, c, t, g, unknown or other
  modified_base (357)..(357): a, c, t, g, unknown or other
  modified_base (411)..(411): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctcaacaataagaacttctagcttggtaccagcagaaaccaggacagcctctaagctgctcatttacctgggcatctatccgggaatccggggtccccctgaccgattcagtggcngcgggtctgggacagatttcactctcaccatcagcagcctgcagctgaagatgngctagtttattactgtcagactatattatagtactctcgagctcacttcgcgtaggaccaaggtgagactacgaaacgaactgtg

SEQ ID NO: 437459 - DNA, 592 bp, Homo sapiens
  misc_feature: GZ8MTXP02JTH8M.13.38.D05.1.454.CMB.2.raw
  modified_base (370)..(370): a, c, t, g, unknown or other
  modified_base (399)..(399): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcaggcaagcccccgaactcctgactctacggtacatccactttgcacagtcggatcccatccgaagttcagtggacagtagatctaggaactagtactttacccnaccatcgagggtctacgagcctagaagtntttgacgtacttactattcgtacaacgtagtacgttacctccgtacccccggtaggtttccggaccgtaagggacccgtaaaggggtacggaaaacttccgaaaggccgtaaaacgtggtaacggtctacgtccgaaaccctaagttaccgttcggttacctttacgtaacctttcccgttaaccccgtaccc

SEQ ID NO: 437460 - DNA, 550 bp, Homo sapiens
  misc_feature: GZ8MTXP02FI5SO.13.38.D05.1.454.CMB.2.raw
  modified_base (362)..(362): a, c, t, g, unknown or other
  modified_base (420)..(420): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcaggcaagtcagaacattggcaactcttaaatggtatcagcagaagtcagggcaagccccgaacctctgatctacggtacatccatttgcacagtggatccatcaagttcagtggcagtagatctaggaacagtacttttacccncaccatcgaggggtctacgagcctagaagtatttgacgtaacttactattgtacaaanagtaacgtttaccttcctacccccggacgtttccgaaccgtaacgggaaccgaaacgggtaggaaaacgtacgaaagacgaaacgtagtacggtactgacaaccgactactcgtcttacactcttccccg

SEQ ID NO: 437461 - DNA, 602 bp, Homo sapiens
  misc_feature: GZ8MTXP02FKW3N.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtgggggtccctcagactctcctgtgcaacctctggattcatttttctctgacgcctggttgagctgggtcccgccgaggccgtccccggggaaggggctgggaggtggggttggccgttaagttaaaggtagaagacgagtggtcggacaacagactacgagtcgttcccgtagaaaggcagattcactatctacaagagatagactacaaaagaatgaatatatctagacaaatgaaacaacctagaaaagcgaaggacacgaggcgtagtaattactagtaaccacagacgtcggggccaaggactaggacaaaagtcgggacccgacggaacggtacggtttaccgaacgtaccggtaccgggggg

SEQ ID NO: 437462 - DNA, 542 bp, Homo sapiens
  misc_feature: GZ8MTXP02IANXQ.13.38.D05.1.454.CMB.2.raw
  modified_base (192)..(192): a, c, t, g, unknown or other
  modified_base (283)..(283): a, c, t, g, unknown or other
  modified_base (301)..(301): a, c, t, g, unknown or other
  modified_base (322)..(322): a, c, t, g, unknown or other
  modified_base (461)..(461): a, c, t, g, unknown or other
tcagtcacgtactacacgaccggtgctcgatttagtatctgatagttgggtttggggagagaagacaggattcaggacaatctccagcatggccggcttccctctcctcctcacccctcctcactcactgtgcagggtcctgggcccagtctgtgctgactcagccaccctcagcgtctgggacccccgggnagagggtcaccatctcttgttctggaagcagctccaacatcggaatattatgtatattggtatcagcagctcccaggaaccgcccccaaangctcatctatagaataancagcggcctcgacgggtcccngaccgattctctggctcccaagtctggcacctcacgccctcccgtggccatccgagtgggcctccggtcgaggtatgaggctgtattatacgtgtgctagcagtgggatagacagccgtgacgtggtccggtgtcgggnggtacggacaggctcgaccgtcgtacggcctacgacccgaaggcctccggtcccccgtacggtcctaccgttccgttcccg

SEQ ID NO: 437463 - DNA, 625 bp, Homo sapiens
  misc_feature: GZ8MTXP02HK8HI.13.38.D05.1.454.CMB.2.raw
  modified_base (238)..(238): a, c, t, g, unknown or other
  modified_base (313)..(313): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaataagaacttctagcttggtaccagcagaaaccaggacagcctctaagctgctcatttacngggcatctatcggaatccggggcccccacgactcagtagcgacgcgggtcgtggacgagagttctactctcaccaactcacgcacgcctcgcacggcgtagaaggaaagtgttacggcgttagtttaattttaacgtagttacgtaaggacctaaattaaatttaactaagtttaaacctacccgtttaccggaaaccgggtcgttacctaaccggtttaccggttaccggggaacggggtaacccggaaaacgggttaagggtaaggaaacgttacgaaaaacccgaaacggttaacgtttgggtaaccgg

SEQ ID NO: 437464 - DNA, 626 bp, Homo sapiens
  misc_feature: GZ8MTXP02FU7NQ.13.38.D05.1.454.CMB.2.raw
  modified_base (222)..(222): a, c, t, g, unknown or other
  modified_base (349)..(349): a, c, t, g, unknown or other
  modified_base (374)..(374): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggnaagtcagaacattggcaactctttaaattggtatcagcagaagtcagggcaaacgccccgaacctcctgatctacggtacatccatttgcactagtggatcccatcccaaggttcagtggcagtagntctggaaactagtactttttacccncacctaatcgaaggggtctacgagcctagaagtagttttgacgtacttacttagttagtactaaactaggtactttacccgttaccgtaccccccggtaacgtttccggacccgtaaaacggggaacccgtaaaggggtacgggtaaaataacgaaaacggacgaaaccgtttacgggtacggtacgtacgaccgtaacctaacgttaccgttacgttaccttaccttaccttacccgtttacccgtacccg

SEQ ID NO: 437465 - DNA, 553 bp, Homo sapiens
  misc_feature: GZ8MTXP02GYLXR.13.38.D05.1.454.CMB.2.raw
  modified_base (238)..(238): a, c, t, g, unknown or other
  modified_base (380)..(380): a, c, t, g, unknown or other
  modified_base (389)..(389): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactacaagtccagccagagttgtttanacagctaccaaacaataagaacttcttagcttggtaccagcagaaaccaggacagcctcctaagctgctacatttactggcatctagtccgggaatcccggggtcctgaccgtattcagtggcagcggggtctgggacagtntttcactcncaccatcagcacgcctgcaggctagaagtatggtgtacttagtttattacgtgtacgagtactaattattatacgtacctcgtaccgagtcctacgtacgttacgggacggtacggaccgtaagggtcggaacgacgtaacgaaacggtacgtaggtacggacg

SEQ ID NO: 437466 - DNA, 584 bp, Homo sapiens
  misc_feature: GZ8MTXP02GHGOO.13.38.D05.1.454.CMB.2.raw
  modified_base (342)..(342): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtggatcccatccaagttcagtgcagtanatctaggaacagtactttacccncaccatcagggtctacagcctagaagtatttggctacttactattgtacaaactagtacgtttacccttccgtaccccccggacgtttccggacccgaaacgggaccgaaacggtacggaaaagttaacgaaaacggaccgtaaaacgtggttacggcgtacggaccgaaccgaacgttacttacgttccttaccgtaacttaccgttaccccgtcccg

SEQ ID NO: 437467 - DNA, 498 bp, Homo sapiens
  misc_feature: GZ8MTXP02HATG1.13.38.D05.1.454.CMB.2.raw
  modified_base (353)..(353): a, c, t, g, unknown or other
  modified_base (360)..(360): a, c, t, g, unknown or other
  modified_base (480)..(480): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctctaagctgctcatttactgggcatctatccggaatccggggtcccctgaccgatcagtgcngcgggtntggggacagatttcactctcaccatcagcagcctgcagctagagatgtgctagtttatatgtacagactaatattatagtctctccgagctcacgttcgcggtacggaccaaggtgaganacaaacgacgtacgtagg

SEQ ID NO: 437468 - DNA, 560 bp, Homo sapiens
  misc_feature: GZ8MTXP02F6MSV.13.38.D05.1.454.CMB.2.raw
  modified_base (342)..(342): a, c, t, g, unknown or other
tcagtcacgtactacacgaccggtgctcgatttagtatctgatagttgggtttgggggagtcagtctcagtcaggacacagcatcggacatgagggtcccgctcagctcctgggctcctgctactctggctccgaggtgccagatgtgacatccagatcgagccagtctccatccaccctgtcctgcgtctctcggagacagggtcaccatcacttggtcggcaagtcagacattgcaactcttaaatgtatcagcagaagcagggcaacgccccgaactcctgatctacggtacatccactttgcacagtcggactccatcccaagttcagtcgcagtagntcgaggaaacagtactttaccctcaccatcgacggggtctaacgagcctagaagtatttgacgtacttactattacgtacaacgtagtacgttaccgttcgtccccggtacgttcggaccgtaacggtacgtaacggtacggaaacgtacgaacgtacgaaacgtcgtacggacgtcgccgaacaactcgtcgttccttcacttccgttccctacccg

SEQ ID NO: 437469 - DNA, 571 bp, Homo sapiens
  misc_feature: GZ8MTXP02GFNEG.13.38.D05.1.454.CMB.2.raw
  modified_base (342)..(342): a, c, t, g, unknown or other
  modified_base (364)..(364): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaactcttaaatggtatcagcagagtcagggcaagccccgaactcctgactctacggtacatccactttgcacagtggactcccatccaagttcagtggcagtagntctagaactagtactttacccnacctatcgtaggggtctaacgagccctagaacgttatttcgacgtacttactattgtacaactagactttacccttccgtacccccggagttcgaccgtaaacgggaccgaaggtagaaaactacgaaacgtacgaaaccgtggtacggccgtacggcctaaccaacttccgttcggttacttacaactttcccgtttaccccgtcc

SEQ ID NO: 437470 - DNA, 510 bp, Homo sapiens
  misc_feature: GZ8MTXP02JL7JW.13.38.D05.1.454.CMB.2.raw
  modified_base (349)..(349): a, c, t, g, unknown or other
  modified_base (357)..(357): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttctagcttggtaccagcagaaaccaggacagcctctaagctgctcattactgggcatctagtccggaagtccgggtcccctgaccgtntcagtgcngcgggtctgggacagtatttcactctcacatcagcagcctgcagctgagatgtggctagtttatatgtacagacaatattatacgtactcgtacgagctacacgtttcggacggaggaccaagggtgacgtactacgaaacgtacgtgtacgg

SEQ ID NO: 437471 - DNA, 591 bp, Homo sapiens
  misc_feature: GZ8MTXP02FNTIL.13.38.D05.1.454.CMB.2.raw
  modified_base (343)..(343): a, c, t, g, unknown or other
  modified_base (363)..(363): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaagccccgaacctcctgatctacggtacatccactttgcacagtggatcccatccaagttcagtgcagtagntctggaacagtatttacccncaccatcaggggtctacagcctagaagtattttgcgtacttactattgtacaactagtacgttaacccttccgtaccccccggtacgtttccggacccgtaaacggggaaccccgaaagggtacgggaaaacgttaccgaaaacggcggtaaaaccgtggttacggaccgttacggcccaaccaacgttacttacggttctttacctacttccctttccccggtaccc

SEQ ID NO: 437472 - DNA, 582 bp, Homo sapiens
  misc_feature: GZ8MTXP02HO5PA.13.38.D05.1.454.CMB.2.raw
  modified_base (314)..(314): a, c, t, g, unknown or other
  modified_base (340)..(340): a, c, t, g, unknown or other
  modified_base (538)..(538): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaatctttaaatggtatcagcagaagtcagggcaagccccgaacctcctgatcgtacggtacatccatttgcacagnggatccatccaagtcagtgcagtagntcgtaggaaactagtaactttttaccccgacaccctaatccgaacgggggttactaaccaggtacccgtaggaaacgttattttgacgtactttaccgttatttcgtacaaactagtacgtttaccctttccgtcccccggtacggtttccggaccgaaggggaacccaaggggtaggaaaactcgaaaagcgaaacnggttacggctcgccacaatctcgtacttcacttccttcccgacc

SEQ ID NO: 437473 - DNA, 601 bp, Homo sapiens
  misc_feature: GZ8MTXP02HSBQ6.13.38.D05.1.454.CMB.2.raw
  modified_base (440)..(440): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggtattttcctcgctgctattttaaaaggtgtccagtgtgaggtgcaagtggtggagtcggtgggggggcttgggttaagcgtgggggtccctgagactctcctgtcgcaacctctggattctattttctctgacgccttggttgagtcgtgggtcccgccgaggccgtcccggggaagggcgtggaggtggggttggaccgttaagttaaaaggtagaagacagtggtacggaacaacgacgactacgagtcgttccgtaggaaagcagattcactatctacaaggnatagactaacaaaagaatagatatatctagactaaatgaaaaccacgtaagaaaagcgaagaaccagaggtcgtagttatacgtacgaaccaacaggagtacgggacaagacgtagaacaagcggccgacgtacggagttaccgacgttacggaccggggg

SEQ ID NO: 437474 - DNA, 519 bp, Homo sapiens
  misc_feature: GZ8MTXP02H4U0L.13.38.D05.1.454.CMB.2.raw
  modified_base (311)..(311): a, c, t, g, unknown or other
  modified_base (356)..(356): a, c, t, g, unknown or other
  modified_base (372)..(372): a, c, t, g, unknown or other
  modified_base (414)..(414): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgtttatacagctaccaacaataagaacttctagcttggtaccagcaagaaaccaggacagcctcctaagctgctcatttacngggcatctatccgggaatccggggtcccctgaccgatcagtggcngcgggtctgggacagntttcactctcaccatcagcagcctgcaggctgaagatgtggntagtttattactgtcagacaattattatagtacctcgtccgaggctcgaacgtttcggacggtacggaccgaaggtggaagactacgaaaacgtaacgtagtcgg

SEQ ID NO: 437475 - DNA, 541 bp, Homo sapiens
  misc_feature: GZ8MTXP02H4Z6I.13.38.D05.1.454.CMB.2.raw
  modified_base (236)..(236): a, c, t, g, unknown or other
  modified_base (418)..(418): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcagagggccaccatcaactgcaagtccaaccagagtgttttanacagctaccaacaataagaacttctagcttggtaccagcaagaaaccaggacagcctacctaaagctgctacatttacgtgggcatctatccggggaatccggggtcctcgaccgtattcgagtggcagcgggtctggactagtatttcgactctccacatcagcagcctgcagctgaaagngtagtgacttagtttatacgtgtacagactaatattatagtactcgtacgagtctactacgtttcggacggtaacggaccgaagggtggaacgacgtacgaaaacgtaccgtagttcggaccg

SEQ ID NO: 437476 - DNA, 500 bp, Homo sapiens
  misc_feature: GZ8MTXP02FG8IN.13.38.D05.1.454.CMB.2.raw
  modified_base (237)..(237): a, c, t, g, unknown or other
  modified_base (357)..(357): a, c, t, g, unknown or other
  modified_base (364)..(364): a, c, t, g, unknown or other
  modified_base (437)..(437): a, c, t, g, unknown or other
  modified_base (443)..(443): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtcccctgaccgattcagtgcngcgggtntgggacagatttcactctcaccatcagcagcctgcggctagaagatgtgcagtttatactgtcagcaatatanagtacnctcgagctcactttcggcgacggaccaaaggtggaagactacaaacgaacgtgtggc

SEQ ID NO: 437477 - DNA, 511 bp, Homo sapiens
  misc_feature: GZ8MTXP02G27Y8.13.38.D05.1.454.CMB.2.raw
  modified_base (365)..(365): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactcctgatctacggtacatccactttgcacagtggatcccatccaaggttcagtggcagtagatctaggaaccagattttacccncacatcaggggtctacagcctgaagtatttgacgacttactattgtcaacagagttaccttctcccccggagttcgacgtaaggaccaagtgaaagtacaagacaacgtagtcgcgtcgcaccaatctgtcttcactctccgtacc

SEQ ID NO: 437478 - DNA, 671 bp, Homo sapiens
  misc_feature: GZ8MTXP02IEJNS.13.38.D05.1.454.CMB.2.raw
  modified_base (347)..(347): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggactaactctttaaattggtatcagcagaagtcaggcaacgccccgaactcctgatcacggtacactccactttgcacagtggactcccatccaaggttcagtgcagtagntcgtaggaaactagtactttttacccacaccctataccgaggggttacctaacgacgtcccgttagaaagtacgttttagccggtaactttaacgttagtttacgtacctaaacgtacgtaacgtttaccccgttcccgtacccccgggtacggtttaccggacccggaaacgggtaaccggtaaacgggtaacgggaaaacgttaaccgaaaacgggtaccggaaaaccgttacggttacgggtaccgtacggtaccaacccggtaacgttccttaacggtttccttaccttaaccggttccccttttaccccggtaaccccg

SEQ ID NO: 437479 - DNA, 570 bp, Homo sapiens
  misc_feature: GZ8MTXP02JESWY.13.38.D05.1.454.CMB.2.raw
  modified_base (240)..(240): a, c, t, g, unknown or other
  modified_base (314)..(314): a, c, t, g, unknown or other
  modified_base (370)..(370): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggagggccaccatcaactgcaagtccagccagagttgttttanacagctaccaacaataagaacttctagcttggaccagcagaaaccaggacagcctactaagctgctcatttacngggcatctagtccgggaagtcccggggtcccctggaccgtattccgaggtcggacngggtccggggtctaggggactagtactttcactcctacaccatcagcacgcctgcaggctagaagagtggtaggctagtttactacgtgtacagtactaaattattaatagtaacctccgtacggtaggtcctacgtacgtttacgggacgggaacggaaccgtaaggtacggagtaactacgaaaacgtacgtgtacgg

SEQ ID NO: 437480 - DNA, 588 bp, Homo sapiens
  misc_feature: GZ8MTXP02HUAPN.13.38.D05.1.454.CMB.2.raw
  modified_base (351)..(351): a, c, t, g, unknown or other
  modified_base (371)..(371): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggctaactctttaaattggtatcagcagaagtcagggcaacgcccccgaactcctagatctaacggtacatcctactttgcacaggtggactcccatccaaggttcagtggcagtantcagaacagtactttacccnctaccatcgaacgggtctaacgagcctagaacgtattttagacgtacttacttatttcgtaactaacgtagtacctttaccgttcccgtacccccggacgtttaccggaccgtaacggggtaccgaaagggtacggaaaactacgaaacgacgtaaactggtacgtccgtacgaccaccaagttctacgttccttactaccttcctttaccccgacc

SEQ ID NO: 437481 - DNA, 562 bp, Homo sapiens
  misc_feature: GZ8MTXP02IUW0I.13.38.D05.1.454.CMB.2.raw
  modified_base (349)..(349): a, c, t, g, unknown or other
  modified_base (369)..(369): a, c, t, g, unknown or other
  modified_base (386)..(386): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagcccccgaacctcctgatctacggtacatccactttgcacagtgggactcccatccaaggttcagtggcagtagntctggaacagtatttacccnaccatcaggggtctacngcctagaagtattttgcgtacttactattgtacaactagtacgtttaccttcctacccccgggtacgtttccggacccaaacggggtaccgaaagggtacggaaaacgtacgaaaagaccgaaacgtcggtacggctacgacaccaatcgtcgttactctacttccttacccgtcc

SEQ ID NO: 437482 - DNA, 559 bp, Homo sapiens
  misc_feature: GZ8MTXP02GG3YW.13.38.D05.1.454.CMB.2.raw
  modified_base (353)..(353): a, c, t, g, unknown or other
  modified_base (373)..(373): a, c, t, g, unknown or other
  modified_base (390)..(390): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccaactttgcacagtgggatccccatcccaaaggttcaggtggacagtagntctgaaacagtatttacccnaccatcgtagggtctanagcctagaagtatttgcgtactacttattgtacaactagactttaccttctcccccggtagttcgaccgaacggacgaaggagtaaacgtacgaaacgacgaacgtacggtacggcgttacggaccaccaacttcgtacgttccttcctaactccgtttaccctacccg

SEQ ID NO: 437483 - DNA, 522 bp, Homo sapiens
  misc_feature: GZ8MTXP02HUFEY.13.38.D05.1.454.CMB.2.raw
  modified_base (362)..(362): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacgggacatcgtgatgacccagtctccagactccctggctgtgtctctgggcgagagggccaccatcaactgcaagtccagccagagtgttttatacagctaccaaacaataagaacttcttaagcttggtaccagcagaaaccaggacagccctacctaagctgctcatttactgggcatctataccggatccggggtcccctgaccgattcagtggcngcgggtctggggacagtactttcactctcaccatcagcagcctgcaggcagaaggatgtggactaggtttatactgactagacaattattatagtactcctacgaggctcacgtttcggcggaggtaccaaggtggacgactacgaaacggacttggacg

SEQ ID NO: 437484 - DNA, 502 bp, Homo sapiens
  misc_feature: GZ8MTXP02FODJ8.13.38.D05.1.454.CMB.2.raw
  modified_base (235)..(235): a, c, t, g, unknown or other
  modified_base (354)..(354): a, c, t, g, unknown or other
  modified_base (430)..(430): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctggcgagagggccaccatcaactgcaagtccagccagagtgtttanacagctccaacaataagaacttcttagcttggtaccagcagaaaccaggacagcctctaagctgctcatttactgggcatctatccggaatccggggtcccctgaccgattcagtggcngcgggtctgggacagtatttcactctcaccatcagcagcctgcaggctgaagatgtggctagtttatactgtcagnaatatatagtactctcgagctcacttcggcgtaggaccgaaggtggaagactacgaaacgtaacgtgtacgg

SEQ ID NO: 437485 - DNA, 565 bp, Homo sapiens
  misc_feature: GZ8MTXP02HKJ0W.13.38.D05.1.454.CMB.2.raw
  modified_base (322)..(322): a, c, t, g, unknown or other
  modified_base (440)..(440): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaaacaataagaacttcttagcttggtaccagacaagaaaccaggacagccctacctaagctgctctatttacgngggctatctagtccgggaattcccggggtccccctggacccgtattcgagtcggcaggtccgggtctggggacaggtactttcactctcaccatcagcacgcctgcaggctagaaagngtggtggtactagtttatactgtacagactaattattatacgttactccgtacgaggtctactacgtttcggacggtaacggaccgtaaagggtgaacgtactacgaaaacgacgttaggtacgg

SEQ ID NO: 437486 - DNA, 555 bp, Homo sapiens
  misc_feature: GZ8MTXP02FQQWU.13.38.D05.1.454.CMB.2.raw
  modified_base (240)..(240): a, c, t, g, unknown or other
  modified_base (371)..(371): a, c, t, g, unknown or other
  modified_base (430)..(430): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagtgttttanacagctacaacaataagaacttcttagcttggtaccagacaagaaaccaggacagcctctaagctgctcatttactgggcatctagtccggggaactcccggggtccccctggaccgtattccgagtggcnggcgggtctgggacagtatttcactctcaccatcagcagccctgcgaggctagaaagtntggtggacttagtttacttagtgtcagactaaattattaatacgtacctccgtaccgaggcttcgtacgtttcgggacggaaggtaccgaaggtcggaagtacgtaacgaaaacgacgtagtcgg

SEQ ID NO: 437487 - DNA, 558 bp, Homo sapiens
  misc_feature: GZ8MTXP02JJH2E.13.38.D05.1.454.CMB.2.raw
  modified_base (286)..(286): a, c, t, g, unknown or other
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaactccngactctacgtacatccactttgcacagtggatcccatccaaggttcagtggcagtagatcaggaaacagtacttttacccncaaccagtcgacgggtctaacacgcctagaagtattttgacgtacttactattcgtacaaacgtagtacgtttacccttccgtacccccggtagttccggaccgtaaacgggaccgtaagggtagaaaacgtcgaaacgcgaaacgtgtacggctcgacgactaactctcgtacttctactccttaccgcc

SEQ ID NO: 437488 - DNA, 520 bp, Homo sapiens
  misc_feature: GZ8MTXP02JF756.13.38.D05.1.454.CMB.2.raw
  modified_base (237)..(237): a, c, t, g, unknown or other
  modified_base (310)..(310): a, c, t, g, unknown or other
  modified_base (355)..(355): a, c, t, g, unknown or other
  modified_base (363)..(363): a, c, t, g, unknown or other
  modified_base (498)..(498): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcagaaaccaggacagcctctaagctgctcatttacngggcatctatccggaatccggggtcccctgaccgattcagtggcngcgggtcnggggacagtatttcactctcaccatcagcagccctgcagctagaacgatggtggactagtttatactgtcagtacaattattagtaagtactccgtcgaggtctctacgtttcggcggaggacgaaggtcggaanacgtacaaacgacgtcgtacgg

SEQ ID NO: 437489 - DNA, 650 bp, Homo sapiens
  misc_feature: GZ8MTXP02IWU5Y.13.38.D05.1.454.CMB.2.raw
  modified_base (306)..(306): a, c, t, g, unknown or other
tcagtcacgtactacacgaccggtgctcgatttagtatctgatagttgggtttgggggagtcagtctcagtcaggacacagcatcggacatgaggtcccgctcagctcctgggctcctgctactctggctccgaggtgccagatgtgacatccagatgagccagtctccatccaccctgtctgcgtctctcgagacaggtcacatcacttgtcggcaagtcagacattgcaactcttaaattggtatcagcagaagtcaggcaacgacccccgaacctcctgactctacggtacataccactttcncacacgtcgggactccatccaacgttcagtcggctacgtagacgtcgtaggaaacacgttactttacccgtacaaccctacgtcgacggggtctacgacgcccgtagacgtatttgacgtacttacttattcgttacaactagtacgtttaccttcccgtccccggtacgtttccggaccgtaaacgggtaccgtaaacgggtacggaaaacgttaaccggaaacggtaaccggtaaaccggttacggttacggggtaccgttaccggaccgtaacccggtaacgttacccttacgggtttaccctttccgtaacctttacccgtttcccccgtttaacccccg

SEQ ID NO: 437490 - DNA, 534 bp, Homo sapiens
  misc_feature: GZ8MTXP02FN3RS.13.38.D05.1.454.CMB.2.raw
  modified_base (238)..(238): a, c, t, g, unknown or other
  modified_base (315)..(315): a, c, t, g, unknown or other
  modified_base (362)..(362): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaaacaataagaacttcttagcttggtaccagcaagaaaccaggacagcctcctaagctgctcatttacngggcatctatccgggaatccggggtccccctgaccgattcagtggcnggcgggtctggggacagtatttcactctcaccatcagcagcctgcagctagaaagatgtggctagttttatactgtcagcaaattattaatagtacctcctccggaggtcctctaccgtttcgggcgggtaagggaccgaaggtggagactacgaaaacgaacgtggtacgg

SEQ ID NO: 437491 - DNA, 512 bp, Homo sapiens
  misc_feature: GZ8MTXP02HG2F2.13.38.D05.1.454.CMB.2.raw
  modified_base (237)..(237): a, c, t, g, unknown or other
  modified_base (309)..(309): a, c, t, g, unknown or other
  modified_base (351)..(351): a, c, t, g, unknown or other
  modified_base (367)..(367): a, c, t, g, unknown or other
  modified_base (405)..(405): a, c, t, g, unknown or other
  modified_base (408)..(408): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctcaacaataagaacttctagcttggtaccagcagaaaccaggacagcctcctaagctgctcattacngggcatctatcggggaatccggggccctgaccgatcagtgcngcgggtctgggacagntttcactctcaccatcagcagccctgctaggctgaagntgnggctagtttatactgtcagctaatatatagtactccgtccgaggtctacgtacgtttcggacggaaggtaccaagggtcgagactacgaaaacgtacgtgtcgg

SEQ ID NO: 437492 - DNA, 489 bp, Homo sapiens
  misc_feature: GZ8MTXP02ID14Q.13.38.D05.1.454.CMB.2.raw
  modified_base (346)..(346): a, c, t, g, unknown or other
  modified_base (368)..(368): a, c, t, g, unknown or other
  modified_base (414)..(414): a, c, t, g, unknown or other
  modified_base (416)..(416): a, c, t, g, unknown or other
  modified_base (481)..(481): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggcaactctttaaattggtatcagcagaagtcagggcaaacgccccgaactccctgatctacggtacatccactttgcacagtggactcccatccaaaggttcagtggcagtnatctggaacagtattttacccnaccatcagggtctacagcctagagtatttgctatactatgtacaananagttacctctccccgattcgctaggacagtgaatcagcgaatgtaggctagcacaatctctctcnctctccgc

SEQ ID NO: 437493 - DNA, 523 bp, Homo sapiens
  misc_feature: GZ8MTXP02GJYWN.13.38.D05.1.454.CMB.2.raw
  modified_base (310)..(310): a, c, t, g, unknown or other
  modified_base (356)..(356): a, c, t, g, unknown or other
  modified_base (395)..(395): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctctaagctgctcattacngggcatctatccgggaatccggggtcccctgaccgattcagtggcnggcgggtctggggacagatttcactctcaccatcagcancctgcaggctagaagatgtggctagtttattactgtacagactaaatattaatagtaactccgtccgaggtctctacgtttcggacggtaggaccgtaaggtgacgactacgaaaacgacgtagtcgg

SEQ ID NO: 437494 - DNA, 545 bp, Homo sapiens
  misc_feature: GZ8MTXP02GRZDO.13.38.D05.1.454.CMB.2.raw
  modified_base (345)..(345): a, c, t, g, unknown or other
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatcccatccaagttcagtggcagtagntctggaaacagtattttacccncaccatcgaggggtctacagcctgaagtattttgcgtacttactattgtacaacagtagtttacccttccgtacccccggtacgttcggccgtaaacgggacccaaagggtacggaaaattacgaaagacgaacgtgtaggtctacgcaccaagtactcgttctctactcttccgacc

SEQ ID NO: 437495 - DNA, 604 bp, Homo sapiens
  misc_feature: GZ8MTXP02IHFB1.13.38.D05.1.454.CMB.2.raw
  modified_base (313)..(313): a, c, t, g, unknown or other
  modified_base (323)..(323): a, c, t, g, unknown or other
  modified_base (421)..(421): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctggggcgagacgggccaccatcaactgcaagtccagccagagttgttttatacagcctaccaaacaataagaacttcttagcttggtaccagacaagaaaccaggacagcctctaagctgctntatttaccgnggctatctacgtaccggtacgtccggtcccctacgacgtagtcgaggtcggcgcgggtcgggtcgacgggactacgtacttccactcctaccacctanacgacgacgacgccgtgacgcggacgtaggaagtagtaggtacgtacgttagtttacttacgtgtacagtaactaattaagttaactaacgttaccgtaccgtacgtacgtaccttacgtacggttcgggaacggtacggaacgtaagggtacgaacgtacgaaacgtaacggtacgtggtcg

SEQ ID NO: 437496 - DNA, 554 bp, Homo sapiens
  misc_feature: GZ8MTXP02FN5OG.13.38.D05.1.454.CMB.2.raw
  modified_base (341)..(341): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactcttaaatggtatcagcagagtcaggcaacgccccgaactcctgatctacggtacatccactttgcacagtggatcccatccgaagttcagtggacagtagntctggaacagtactttacccataccctatcgtacggggtctacgacgccgtagaagtattttacggactacttaactattcgtactaacgtagtacgttacccttaccgtacccccggtacgttccgaccgtaacgggaccgtaaggtacgaaactacgaacgtacgaacgtgtacggcgtcgacacaagtctcgtctacactcctaccctcc

SEQ ID NO: 437497 - DNA, 523 bp, Homo sapiens
  misc_feature: GZ8MTXP02G1LEV.13.38.D05.1.454.CMB.2.raw
  modified_base (237)..(237): a, c, t, g, unknown or other
  modified_base (311)..(311): a, c, t, g, unknown or other
  modified_base (355)..(355): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttctagcttggtaccagcaagaaaccaggacagcctcctaagctgctcattacngggcatctatccggaatccggggcccctgaccgattcagtggcnggcgggtctggggacagtatttcactctcaccatcagcagcctgcaggctgaagatgtggctagtttatactgtacagtataattattatagtactccgtacgaggctactacgtttcggacggtacggaccgaaggtggaagtactacgaaaaccgtacgtgtacgg

SEQ ID NO: 437498 - DNA, 552 bp, Homo sapiens
  misc_feature: GZ8MTXP02H9RQW.13.38.D05.1.454.CMB.2.raw
  modified_base (346)..(346): a, c, t, g, unknown or other
  modified_base (369)..(369): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggctaactctttaaattggtatcagcagaagtcagggcaagccccgaactcctgatctacggtacatccactttgcacagtggatcccatccaaggttcagtggacagtagntctaggaacagtacttttacccncaccatcgaggggtctacagcctagaagtattttagacgtacttactattgtacaactagtacgttaccttccgtacccccggtacgttccggacctaacgggaccgaaggtacggaaaactacgaaagacgaaactacggtcgacgtcgcacgtaatctcgtcttacacttccttacccgac

SEQ ID NO: 437499 - DNA, 594 bp, Homo sapiens
  misc_feature: GZ8MTXP02I22SK.13.38.D05.1.454.CMB.2.raw
  modified_base (347)..(347): a, c, t, g, unknown or other
  modified_base (368)..(368): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcagggcaacgccccgaacctcctgatctacggtacatccactttgcacagtggatcccgataccaagttcagtggcagtagntcaggaacagtactttacccncaccatcgaggggtctacacgcctagtaagtattttggaccgtacttacttaatttgtacctaaactagtaacgtttacccttaccgtaccccccggtacgttccggaccgtaaacgggtaacccgaagggtacggaaaacgttacgaaaacggtacgaaaccgtggttacggacgttcggaccaaccctgtaccttcggttacttcacttcctttccccgtaccc

SEQ ID NO: 437500 - DNA, 740 bp, Homo sapiens
  misc_feature: GZ8MTXP02IUIZ8.13.38.D05.1.454.CMB.2.raw
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacacgaccccaggccaggcctccgcgcacgctcatctacaacacaaaacactcgctcttccgtcggggtccctcactccgtcttctctcggcctccacttccgttaggggaaaacctaaacggtcctacgtacccctttatacctaacgttcccggaacccggggggccccgaaggggaccgaaggaaaacgtaagtacggaaaattccgttaggtaaattttaaatttaaccgtttggtttagttttacgttttaagttaacggttgggggttaaagttcggtacccttaatttttcgtcgttccgtttggggtttcgggtttacgggggtaacggggtaaacggggccccggtaacccccggggtaccgttccggtaacccccgggtttcccgttacccggggtttaccggaaaacccggtacccccggaaaacgggggtcccctttacccggggtaacccccccg

SEQ ID NO: 437501 - DNA, 530 bp, Homo sapiens
  misc_feature: GZ8MTXP02JAA8X.13.38.D05.1.454.CMB.2.raw
  modified_base (309)..(309): a, c, t, g, unknown or other
  modified_base (352)..(352): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctctaagctgctcattacngggcatctagtccggatccgggtcccctgaccgatcagtggcnggcgggtctgggacagtatttcactcctcaccatcagcagccctgcagctagaagatgtgctagtttatactgtcagactaatattatagtactccgtacgacggtctacgtacgtttcggacgggtacgggaaccgtaagggtcggaacgacgtaaccaaaacggtaactggtacgg

SEQ ID NO: 437502 - DNA, 597 bp, Homo sapiens
  misc_feature: GZ8MTXP02GYTH2.13.38.D05.1.454.CMB.2.raw
  modified_base (240)..(240): a, c, t, g, unknown or other
  modified_base (322)..(322): a, c, t, g, unknown or other
  modified_base (398)..(398): a, c, t, g, unknown or other
  modified_base (455)..(455): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagtagttgttttaanacagcctaccaaacaataagaacttctagcttggaccagcaagaaaccaggacacgcctacctaagctgctactatttacgngggctattctagtacccggggtaacgtcccggggtaccccctggaccgtattccgaggtcggcgagggtccgggtntggggacctagtactttcacctctccaccatcagcacgccctgcgagctagaaagtntggtaggtactagtttactaacgtgtacagtactaaattacttaagtactaccttaccgtacgtacggtacctcggtaccgtttcgggacggtaacgggaaccgtaagggtacgaagtactaacgaaaacgtcgtaggtacg

SEQ ID NO: 437503 - DNA, 614 bp, Homo sapiens
  misc_feature: GZ8MTXP02HU1U8.13.38.D05.1.454.CMB.2.raw
  modified_base (345)..(345): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgatctacggtacatccactttgctacagtgggactcccatcccaagttcagtggcagtagntctggaacagtatttaccctcacccatcgaggggtctacgagccttagaacgtattttgcgtacttacgtatttgtactaactagtaacgtttacccttccgtacccccggtacgtttaccgggacccgaaacggggaacccgaagggttacgggaaaacgttcgaaacggtaccgtaaacgttacggtacggtccgttacggaccgtaccctaacgttccgttacggtttccctttacctaacctttacccgttttcccccgtacccg

SEQ ID NO: 437504 - DNA, 549 bp, Homo sapiens
  misc_feature: GZ8MTXP02JPW7K.13.38.D05.1.454.CMB.2.raw
  modified_base (191)..(191): a, c, t, g, unknown or other
  modified_base (279)..(279): a, c, t, g, unknown or other
  modified_base (324)..(324): a, c, t, g, unknown or other
  modified_base (535)..(535): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgtctggaagcagctccaacatcggaagtaattatgtatattggtatcagcagctccaggacgccccaaangctcatctataggaataatcagcgcctgacggggtccctgaccgnttctctggctcccaagtctggcacctcacgccctcccgtggcccatcgaggtcgggcctccgggtccgaggatcggaggctgattattacgtgtgcagcagtgggatgacagcctggaggtggtccggtggttcgggcgggacgggaccgaggcgtacggacccgtcgtacgggtcacggacccgaagggcctccggcccccgtggtaccnccgttccgttcccg

SEQ ID NO: 437505 - DNA, 680 bp, Homo sapiens
  misc_feature: GZ8MTXP02HHWMB.13.38.D05.1.454.CMB.2.raw
  modified_base (192)..(192): a, c, t, g, unknown or other
  modified_base (293)..(293): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcagcgtctcgggacccccgggnagagggtcaccatctcttgttctggaagcagcctaccaaacatcggaaagtaattatgtatattggtatcagcagcctcccgaggaaccggacccccaaangctacatctaataaggaaataatcaggccggccctcgacggggtcccctaggaccgtattcctcgtggcctaccccgtaagtccgtcggacctaccctcacgtccccttcccgtcggaccctagtccgagggtcggggtcccgtcccgggtaccggaggtacgtaggacggtcttagtaactttacgttacgtggtcgcgtagtcgtaggtcgggtatcggacgtacgccgtaggtacggttcggggtccgggttgggttccggggacgggtaacggggaaccgtaacggtccgtacggtacccggttaccgtacgggtaccaccggaacccgaacggtcccgtacccggtcccccgtacgggtaccctaccgtttccgttcccccg

SEQ ID NO: 437506 - DNA, 639 bp, Homo sapiens
  misc_feature: GZ8MTXP02G14YG.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggcaagtcaagacattggactaacttctttaaattggtatcagcagaagtcgagggacaacgacccccgaacctcctgtactcgtacggtaccacttcctactttcgacactaggtcggactcccataccgtaaggttcaggtcggctaagtagtactcgtacggaaactacgttacttttaccccgacaacccgtacgttacggaacgggggttactaaccgacgtacccgttagtaacgttattttcggaccgtactttacgttattacgtactaacgtacgttactttacccgttccgtacccccggtacgttaccggaccgtaaaggacccgtaaggtacgaacgtacgaacgacgtacgtacgtcggtactcgacctacaacgttctacgttcttaccgactttccctaccgtaccc

SEQ ID NO: 437507 - DNA, 629 bp, Homo sapiens
  misc_feature: GZ8MTXP02HZEKV.13.38.D05.1.454.CMB.2.raw
  modified_base (220)..(220): a, c, t, g, unknown or other
  modified_base (230)..(230): a, c, t, g, unknown or other
  modified_base (317)..(317): a, c, t, g, unknown or other
  modified_base (346)..(346): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcggnaagtcagacnttggctaactcttaaattggtatcagcagaagtcgagggcaacgccccgaactcctgactctaacggtacatccactttgcacgagnggactccatccaagttcagtggcagtagngtcgtaggaactacgttaacttttacccgactacctacgtacgacggggttactacgagtcccgttagtaacgtatttttgaccgttacttaccgttaagtttcgtaactaaacgtagttaacgtttacccgtttcccgtacccccggtacgttaccgggtaccgaaacgggtacccgaaaggtacggtaaacgtaacgaacggtaacgaaacgttacggtacgtacgtacggacctaccgaacgttacttcggtaccttactaccttccgtttacccgtccg

SEQ ID NO: 437508 - DNA, 571 bp, Homo sapiens
  misc_feature: GZ8MTXP02F3O8Z.13.38.D05.1.454.CMB.2.raw
  modified_base (344)..(344): a, c, t, g, unknown or other
  modified_base (347)..(347): a, c, t, g, unknown or other
  modified_base (365)..(365): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaattggtatcagcagaagtcagggcaagccccgaacctcctgatctacggtacactccactttgcacagtgggatccatccaaggtcagtgcagtagntcnggaacagtactttacccncaccatcgaggggtctacagccctagaagtatttgcgtacttactaattgtacaacagtacgttaacccttcctaccccccggtacgttccggaccgtaaacggggacccgtaaagggtacggaaaagtacgaaaggaccgtaaacgtacggtaggtcgtacgcctaaccaacgttccttcgtccttctactccttcccgtacccg

SEQ ID NO: 437509 - DNA, 590 bp, Homo sapiens
  misc_feature: GZ8MTXP02HTB8Q.13.38.D05.1.454.CMB.2.raw
  modified_base (342)..(342): a, c, t, g, unknown or other
  modified_base (364)..(364): a, c, t, g, unknown or other
  modified_base (383)..(383): a, c, t, g, unknown or other
  modified_base (396)..(396): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagacattggcaatcttaaattggtatcagcagaagtcagggcaagccccgaactcctgatctacggtacatccactttgcacagtgggatcccatccaaggttcagtgcagtagntcgtagaacagtactttacccntaccatcgaggggtctacngccctagaacgtnttttgacgtacttactatttcgtacaacgtagtacgtttacccttccgtaccccggtacgttccggaccgaacggggacccaaagggtacggtaaaactacgaaacggacgaaacgttagggttacggcgttacggacctacctaaacgttcgttcgtttaccgttacttaacgtttccctttccccggtaccc

SEQ ID NO: 437510 - DNA, 525 bp, Homo sapiens
  misc_feature: GZ8MTXP02FSSTN.13.38.D05.1.454.CMB.2.raw
  modified_base (317)..(317): a, c, t, g, unknown or other
  modified_base (343)..(343): a, c, t, g, unknown or other
  modified_base (378)..(378): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccaaaccagagttgttttatacagctaccaaacaataagaacttctagcttggtaccagcaagaaaccaggacagcctaccaagctgctcatttacnggcatctatccggaatccggggtccngaccgattcgagtggcagcgggtctggggacagtntttcactctcacatcagcagcctgcaggctagagagtgtggctagtttatacgtgtacagactaattagtatagtactcctacgagtctcgtacgttcggacggacggtaccgaaggtcggaagatacgaaacgaacgtggtgtacg

SEQ ID NO: 437511 - DNA, 590 bp, Homo sapiens
  misc_feature: GZ8MTXP02FUBN3.13.38.D05.1.454.CMB.2.raw
  modified_base (200)..(200): a, c, t, g, unknown or other
  modified_base (345)..(345): a, c, t, g, unknown or other
  modified_base (368)..(368): a, c, t, g, unknown or other
tcagtcacgtactacacgaccggtgctcgatttagtatctgatagttgggtttgggggagtcagtctcagtcaggacaaagcatggacatgagggtccccgctcagctcctggggctcctgctactctggctccgaggtgccagatgtgacatccagatgagccagtctccatccaccctgtctgcgtctctcggagacngggtcaccatcacttgtcgggcaagtcagaacattggctaactctttaaattggtatcagcagaagtcagggcaacgccccgaactcctgatctacggtacatccactttgcacaggtggactccatcaagttcagtggcagtanatctggaactagtactttacccncaccagtacgtacggggtctacgagccgtagtaacgtagttttacgacgtacttacttattagtaccaaatacgtactttacccttccgtacccccggtacgttccggaccgtaacgggaacccgtaaagggtagtaaacgtaccgaacggacgtaaaccgttggtcggtctacggtaccactaactcgtcgtttactctactttccgttaccccgtactac

SEQ ID NO: 437512 - DNA, 639 bp, Homo sapiens
  misc_feature: GZ8MTXP02GMM9G.13.38.D05.1.454.CMB.2.raw
  modified_base (240)..(240): a, c, t, g, unknown or other
  modified_base (253)..(253): a, c, t, g, unknown or other
  modified_base (322)..(322): a, c, t, g, unknown or other
  modified_base (434)..(434): a, c, t, g, unknown or other
  modified_base (458)..(458): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagtagttgtttanacagctaccaaanaataagacttcttagcttggaccagcaagaaaccaggacagccctacctaaagctagctatatttacgngggacatactacgtaccggggaaatcccggggtacccctaggacctattacgagtcgggacaggggtccgggtacgtggggaaccaggtactttcactcctacgaccatcancgagcctgaccgagtctagaaagngtggtacggtctaaggttttatacgtagtctaagtactaaatttattaagtacttacccgtaccgtaccggtacgggtccttacggtacccggtttacggggacccgggtaacggggtaaccggtaaaggggtacggtaacggtaaccgtaaacggaaaaccggtaaccggttgggtacgg

SEQ ID NO: 437513 - DNA, 673 bp, Homo sapiens
  misc_feature: GZ8MTXP02F6F0J.13.38.D05.1.454.CMB.2.raw
  modified_base (191)..(191): a, c, t, g, unknown or other
  modified_base (290)..(290): a, c, t, g, unknown or other
  modified_base (333)..(333): a, c, t, g, unknown or other
  modified_base (412)..(412): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccctcagcgtctcgggacccccggnagagggtcaccatctcttgttctggaagcagctaccaacatcggaaataattatgtatagttggtatcagcagcctcccgaggaaccggacccccaaanagctcatctataggaaataatcagccggcctgacggggtcccngaccgtattctctggctcccgaagtctgccacctcacgccctccgtggcccatcgaggtcgggccgtcccggtcgaggngtggacggtctagtactttaagttacgttgtacgtacgagtccgtaaggtacggggtaatcggaaccgtacggtaccccgttaggggtaccggggttcgggggttcccggggtttcggggttacgggggtaccggggaaacggggaaccgtaaacgggtccgtaccggggtaccccggttaccggtacggtaccgaccggtacccgaacggggtcctacccggcccccgtacgggtaccctaccgttcccgtttcccccgg

SEQ ID NO: 437514 - DNA, 790 bp, Homo sapiens
  misc_feature: GZ8MTXP02IQR7Y.13.38.D05.1.454.CMB.2.raw
  modified_base (201)..(201): a, c, t, g, unknown or other
tcagtcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtggganacagagtcattatcacttgccgggccactctagtttgttggtaggtggttgtcctggtatcagacaaaagccagggacaacgcccctaaactcctgtactcgtttggacggtcgttacgttaacgtttaacgggaacgggggtacttaccgtaccgacccgtacgggttacgaacgggtccggtacgtacgggttacggtacgttaccggtaggggtaacctaacggtaacctttacccaacccccttaccaaacccctaactaacccaaaaccgtacgtacccgttaggacccacggtacccgtaaggtaaacgtaccttaccgtacggtaacccttaaaaccgtttaacctaaccgtttacgtaaaccctaaaaccttaaacggtttaaatttaaaacctttaaccttttaaacctttaaccgtttaaccggtttttacgggaacccgggttaaacggggtaaaacccgtaaaaggggttacggaaacgtaaacgtaaaccgaaaacgtaacgttacgggtacggtacctacgacctaacctaacgttacgttacgttaccttactacctttcccgttaccctaccg

SEQ ID NO: 437515 - DNA, 733 bp, Homo sapiens
  misc_feature: GZ8MTXP02GNGBN.13.38.D05.1.454.CMB.2.raw
  modified_base (198)..(198): a, c, t, g, unknown or other
  modified_base (233)..(233): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcgganacagggtcaccatcacttgtcggcaagtcagaacnttggcaactcttaaatggtatcagcagaatcagggcaacgccccgaactcctaggatctacggtacaacttcctactttggactacgtacgtcgggactcccgtaatccgtaaacggttcaaggttcggactaaggttacgacgttacgtagggtaaacctaaggttaacctttttaaccccgacgtaaaccctaacgttaccgtaacgggggttacccttaaacggacgtacccgttaaggtaaacgttagtttttacggacgttaaacgtttaccttaagtttacgtacctaaacgtacgtaacgtttacccgttacccgttacccccggtaggtttacccggaccgtaaacggggtacccgtaaaggggttacggaaaacgtacccgttaaaggaccggtaaaaccggttcgggtaacggtcgttaacggcctaacccggtaacttaccgttcggttaccgtttccgtaactttcccgttaccccggtttaaccccg

SEQ ID NO: 437516 - DNA, 567 bp, Homo sapiens
  misc_feature: GZ8MTXP02F5VHJ.13.38.D05.1.454.CMB.2.raw
  modified_base (239)..(239): a, c, t, g, unknown or other
  modified_base (317)..(317): a, c, t, g, unknown or other
  modified_base (468)..(468): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttanacagctaccaacaataagaacttcttagcttggtaccagacaagaaaccaggacagcctcctaagctgctcatttacngggcatctacgtccgggaaactccggggtcccctagaccgtattcagtggcagggccgggtcgtaggggaccagtactttaccgacttcctacaccatacagcgacgcctgacaggctacgaaagatggtggactagtttatactgtacanacgtaattataattacgtactccgtacgagtcctacgtacgttcggacggaggtaaccgaagggttggaacgtactacgaaaacggtacgtaggtacgg

SEQ ID NO: 437517 - DNA, 525 bp, Homo sapiens
  misc_feature: GZ8MTXP02I84DY.13.38.D05.1.454.CMB.2.raw
  modified_base (223)..(223): a, c, t, g, unknown or other
  modified_base (475)..(475): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctccgtggagggacagtcacactcacttgnggcttgagatacgactcagtctctagtagttactacccagctggtaccaacacgaccccagccaggctccgcgcacgctcatctacaacacaaacactcgctcttctggggtccctcgatcgcttctctgctccatccttgggaacaaagctgcccttatcatcgacgggggcccaggacagaagatagaatctagtattattacttgttgtttctttatagtgggtagtgtctagtttctgctgtgttggnggagtcgaccgctcgaccgtccgtcgtcacgaccacggcctcggaccccg

SEQ ID NO: 437518 - DNA, 604 bp, Homo sapiens
  misc_feature: GZ8MTXP02GMLYC.13.38.D05.1.454.CMB.2.raw
  modified_base (349)..(349): a, c, t, g, unknown or other
  modified_base (373)..(373): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacaggtggactcccatccaaggttcagtgactagtagntcgaggaactagtacttttacccncaccatcgagggtcacgacgcctagaatagtttgacgtacttactattcgtacaaactagtacgtttacccttaccgtacccccggtagttccggtaccgaaacggggtaacccaaggggtaggtaaaacgtacgaaaacggtaccgtaaacgttcggtacggtaccgttacggacccgtaacctaattcgttacgttcctttacgtaacctttccctttaccccgtcccg

SEQ ID NO: 437519 - DNA, 585 bp, Homo sapiens
  misc_feature: GZ8MTXP02HEBCQ.13.38.D05.1.454.CMB.2.raw
  modified_base (311)..(311): a, c, t, g, unknown or other
  modified_base (433)..(433): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctacaacaataagaacttctagcttggtaccagcaagaaaccaggacagcctctaagctgctcatttacngggcatctagtccggaaagttcccgggtcccctagaccgtattccgaggtcggcaggcgggtcgtagggaccagtactttcactctacaccatcgagcgacgtcctgaccgaggcagaaagngttggaggtacttagtttaacttaccgtagtaccgagtactaaattagttaataacgttaacccttccgtaccggtaggtccttacgtaaccggtttcggacgggacggtaaccgaagggtaggacgtaactaccgaaacgtacgtaggtcg

SEQ ID NO: 437520 - DNA, 511 bp, Homo sapiens
  misc_feature: GZ8MTXP02H97JA.13.38.D05.1.454.CMB.2.raw
  modified_base (360)..(360): a, c, t, g, unknown or other
  modified_base (416)..(416): a, c, t, g, unknown or other
  modified_base (419)..(419): a, c, t, g, unknown or other
  modified_base (455)..(455): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcagagggccaccatcaactgcaagtccagccagagttgtttatacagctaccaacaataagaacttcttagcttggtaccagcagaaaccaggacagcctctaagctgctcatttactgggcatctatcccggggaatccggggtcccctgaccgatccagtggcngcgggtctgggacagatttcactctcacccatcagcagcctgcaggctgaagatgnggntagtttatactgtcagacaatattatagtacttccncgagctctactttcggcggtaggaccgaaggtgagatacgaaacgaacttggacgg

SEQ ID NO: 437521 - DNA, 559 bp, Homo sapiens
  misc_feature: GZ8MTXP02GESY4.13.38.D05.1.454.CMB.2.raw
  modified_base (237)..(237): a, c, t, g, unknown or other
  modified_base (375)..(375): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagacttcttagcttggtaccagcaagaaaccaggacagcctctaagctgctctatttactgggcatctaagtccggggaaattcccggggtccccctaggacccggtattaccgagtgggcngggcggggtctgggggaccagtactttcgactctacacccatcagcagccctgccgaggctagaaagatggtaggtctagtttattactgtacagacaaattattagtatactacctcggagtcctcacgtttcgggacggtaacggaccgaaggtggaagactacgaaaacgaacgtagtcgg

SEQ ID NO: 437522 - DNA, 560 bp, Homo sapiens
  misc_feature: GZ8MTXP02FRI5W.13.38.D05.1.454.CMB.2.raw
  modified_base (197)..(197): a, c, t, g, unknown or other
  modified_base (286)..(286): a, c, t, g, unknown or other
  modified_base (342)..(342): a, c, t, g, unknown or other
  modified_base (364)..(364): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcggcaagtcagaacattggcaacttctttaaattggtatcagcagaagtcaggcaacgccccgaactcngatctacgtacatccactttgcacagtcggatcccatccaaggttcagtgcagtantcaggaacagtacttttacccncaccctatcgagggtctacgagcctagaagttatttgcgtacttactattgtacaactagtacgttaccttccgtacccccggtacgttaccggaccgtaaacgggacccgtaaaggtacgggaaaacttacgaacggacgtaaacgtggtacggcgtacgacctaccaactcgtctacttcacttcctaccgtcc

SEQ ID NO: 437523 - DNA, 640 bp, Homo sapiens
  misc_feature: GZ8MTXP02JQH73.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggacaacttctttaaattggtatcagcagaagtcagggcaacgccccgaactcctgatctacgtacatccactttgcacagtggactccatcccaaggttcagtgcagtagatctaggaaactagtactttacccacacctatcgagggtctacgagtccctagaacgtagttttcgacgttacttaacttagtttagtacctaaacgtacgtaacgtttaacccctttcccgtacccccggtacgtttaccggacccgtaaacggggaacccgtaaagggtaacgaaaacgttaccgaaaacggtaccggtaaaaccgttgggtacggtaccgtacggtacccgaacccgtaagttacctacgtttcccttaccgtaacctttccccggttacccccgtaacccg

SEQ ID NO: 437524 - DNA, 623 bp, Homo sapiens
  misc_feature: GZ8MTXP02JH9EW.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcaacctctggattcattttctctgacgcctggttgagctgggtccgccaggcctccccggggaaggggctgggagtgggttggccgttagttaaaggtagaagacgagtggtcggacaacagactacgagtcgttcccgtagaaagcagattcactatctacaagagatgactacaaaagaatagaatataatctagactaaaatcgaaacaaccgtagaaaagcgaaaggaccaacgaggtactaggtaactttacgacgtaaccacgtaaggacgttacgggggacctaaggaactacggacctaaaagtccgggacccggacggaacggtacgtttaccggaacgttaccggtaaccgggggg

SEQ ID NO: 437525 - DNA, 582 bp, Homo sapiens
  misc_feature: GZ8MTXP02I71QR.13.38.D05.1.454.CMB.2.raw
  modified_base (191)..(191): a, c, t, g, unknown or other
  modified_base (219)..(219): a, c, t, g, unknown or other
  modified_base (229)..(229): a, c, t, g, unknown or other
  modified_base (286)..(286): a, c, t, g, unknown or other
tcagtcacgtactacacgaccggtgctcgatttagtatctgatagttgggtttggggagagaagacaggattcaggacaatctccagcatggccggcttccctctcctcctcaccctcctcactcactgtgcagggtcctgggcccagtctgtgctgactcagccaccatcagcgtctggggacccccggnagagggtcaccatctcttgttctggaancagctccaantcggaagtaattatgtatattggtatcagcagctacccgaggaaccggcccccaaangctcatctataggaatatcagccggccctcgacggggtccctagacagtacttctctcggtcctaccaagtctcggccacctcgacgccctcccgtcgccatcgaggtcgggcctcccggtccgaggtgtgaggcctaggtactttagttactgttcgcgtagcgtagttgggatgacgacgccgtggtacggtgggtccgggtgtcgggacgggacggaccgaacggccgtacggacccgtacgtacggaccgaacggacccgaacggccgtaccgtcccccgtcgtacctcccg

SEQ ID NO: 437526 - DNA, 546 bp, Homo sapiens
  misc_feature: GZ8MTXP02FTT8K.13.38.D05.1.454.CMB.2.raw
  modified_base (326)..(326): a, c, t, g, unknown or other
  modified_base (515)..(515): a, c, t, g, unknown or other
tcagtcacgtactacacgaccggtgctcgatttagtatctgatagttgggtttgggggagctacaacaggcaggcaggggaagcaagatggtgttgcagacccaggtcttcatttctctgttgctctggatctctggtgcccacggggacatcgtgatgacccagtctccagacctccctggctgtgtctcgtgggcgagaggccaccatcaactgcaagtccagccagagttgttttatacagctaccaaacaaataagaacttctaagcttggtaaccagcaagaaaacccaggacagcctacctaaagctgctctatttacgnggacatctagtccgggaatcccggggtcctcgaccgtacttcgagtggccaggtcgggtctggggaacagtattcactctcacatcagcagctgcagctagagatgtggactagtttattactgtacagactaattattatagtactccttcgaggtctcgtacgttcggacggacggaaccgtaaggnggtaagactaacgaaacgaactcggagtacg

SEQ ID NO: 437527 - DNA, 545 bp, Homo sapiens
  misc_feature: GZ8MTXP02IDQ6Y.13.38.D05.1.454.CMB.2.raw
  modified_base (370)..(370): a, c, t, g, unknown or other
tcagtcacgtactacacgaccggtgctcgatttagtatctgatagttgggtttggggctgggagaggagccccagccttgggattcccaagtgttttcattcagtgatcagcactgaacacagaggactcaccatggagtttgggctgagctggattttccttgttgctattttaaaaggtgcccagtgtgaggtgcagctggtggagtctggaggaggcttgatccagccgtgggggtccctgagactctcctgtgcagcctcgtgggtcaccgtcagtcacacctacatgagctgggtccgccaggctccgaggggaaggggctgggagtgcgtctcttttattatagtagtggtagtacatactcgnagactccgtgacggggccattcaacatctaccagagaacaatccaaagaacacgcttgttacttacaaatgaacacgacctgaacgagaccgagtcgaacgacggccgtagtactacgtgagcgaagagacgtcggggacccaagaacgttacgacgacgtagcggaacgtcggg

SEQ ID NO: 437528 - DNA, 836 bp, Homo sapiens
  misc_feature: GZ8MTXP02HHZ7D.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacagggtccaccatcacgttggtcgggacaagtcagaactagttggactaacttactttaaattggtatcagcaagaacgtcgaagggccaacgccccccgtaactcctagtactccgtaacggtactacttaccctactttcgacctaacgtacgggtacgggtacctaccccgtaagttaaccccggttaaacggggtttaccgaaaggggtttacggggttaaaggttaaacggttaacgtttaccgggttaaacgggtaaaaccgttaaaccgggttttaaccccttttttaaacccccgtaacccaaaccccgttaacggtttaccggggtaaaccgggggtttaccctaaaccggtaccgtaacccggttaagggtaaaacgtttcgtttttacgggacccgttaaactttaaccgttaagtttaccgttaaaccttaaaaccgtacggtttaaccgttttacccccgttacccggtaccccccgggttaacggttcccggaaaccggaacggggtaaacccgtaaagggttaacggaaaacttacggaaaacggtaccgtaaacgtcggtaggcctacgtacccaacgtatccttagttccttactacctttcccgttaccgacttaacg

SEQ ID NO: 437529 - DNA, 584 bp, Homo sapiens
  misc_feature: GZ8MTXP02FWO0J.13.38.D05.1.454.CMB.2.raw
  modified_base (382)..(382): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtggggggtccctcgagactctcctgtgcaacctctggattcattttctctgacgcctggttgagtcgtgggtccgccgaggccgtccccggggaagggcgtggaggtggggttggccgtagttaaaggtagaagacagtggtacgganaacagactacagtcgttcccgtagaaaggcagattcactatctacaaagagatgactaacaaaagaatagatatatctagacaaatgaaacaactagaaaagcgaaggacacgaggacgtagtacttacgacgtacacgagagtcggaccagactgactaaagtcggacgacgacggacgttacgacgtacggtaccggggg

SEQ ID NO: 437530 - DNA, 675 bp, Homo sapiens
  misc_feature: GZ8MTXP02F4IIG.13.38.D05.1.454.CMB.2.raw
  modified_base (367)..(367): a, c, t, g, unknown or other
  modified_base (392)..(392): a, c, t, g, unknown or other
tcagtcacgtactacacgaccggtgctcgatttagtatctgatagttgggtttgggggagtcagtctcagtcaggacacagcatggacatgagggtccccgctcagctccgtggggctcctgctactctggctccgaggtgccagatgtgacatccagatgagccagtcctccatcccaccctgtctgcgtctcgtcggagacgagggtccaccatcacgttggtcggacaagtcagaacagttcggacaacttctttaaattggtatcagcagaagtcgaggcaacgccccaacctctgactctacggtacatcctactttgcacgagtcggactccatacctaaggttcaaggtgacgagttagntcgaggtaaacagtacttttacccncaacctatacgtaggggtcctaacgacgtcccgtaagagttagttttacgaccgttacttaacttagttacgtaccgaaaactacgttaaccgtttaaccccgtttcccgtaccccccgggtacgttacccggtacccggtaaaccgggtaaccgtaagggtaacggtaaaacgttaccggaaacggtaaccgaaacggttacggtacggtaccgtcggtaacctaccgaacttcgtaaccgtttccgttaccgtaaccttcccgtttaccccggttaccccg

SEQ ID NO: 437531 - DNA, 644 bp, Homo sapiens
  misc_feature: GZ8MTXP02GIHGT.13.38.D05.1.454.CMB.2.raw
  modified_base (330)..(330): a, c, t, g, unknown or other
  modified_base (467)..(467): a, c, t, g, unknown or other
  modified_base (643)..(643): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgacaagtccagccagtagttgtttatacagctacaaacaataagacttctagcttaggtaccagacaacgaaacccaggacacgacctaccgtaaagctcgtctactaagtttacgngggcctaagttccgttaacggtacccggggaaaccggttccccggggtaccccccttacggaaccgtacgttaccgaggttcggccgaggggtccgggttacgtacggggactagtactttcaacctctacacctanacgagacgcgcccgtgacgtagactagaaagtgtggtaggtaccgttatttacgttaatcggtatataacttaaaattatttaacgtaacggttacctccgtacgtacggtccttacgtaacgttcggggaacggtaacggtacgaaggtcggaatacggtaacaacgtagtcggng

SEQ ID NO: 437532 - DNA, 554 bp, Homo sapiens
  misc_feature: GZ8MTXP02JQRXR.13.38.D05.1.454.CMB.2.raw
  modified_base (348)..(348): a, c, t, g, unknown or other
  modified_base (371)..(371): a, c, t, g, unknown or other
  modified_base (395)..(395): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactcttaaatggtatcagcagaagtcagggcaagccccgaactcctgactctacggtacatccactttgcacagtgggatcccatccgaaggttcaggtcggcagtagntctaggaactagacttttacccncacctatcgacggggtcctaacgngccgtagaagtattttcgacgtactttactattgtacaacgtagtacttaccgttacctccccggtacgttccggaccaacgggaccgtaaaggtacgaaatacgaagcgaaacgtgtacgctcgacacgtaatctacgtacttcacttccgtacctcc

SEQ ID NO: 437533 - DNA, 533 bp, Homo sapiens
  misc_feature: GZ8MTXP02JALBZ.13.38.D05.1.454.CMB.2.raw
  modified_base (284)..(284): a, c, t, g, unknown or other
  modified_base (365)..(365): a, c, t, g, unknown or other
  modified_base (522)..(522): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgcgggcaagtcagaacattggcaactcttaaattggtatcagcagaagtcaggcaagccccgaactccngatctacggtacatccactttgcacagtcggatccatccgaagttcagtgcagtagatctaggaaacagtacttttacccncaccatcgagggtactacgacgcctagaacgtatttgacgtacttacttattgtacaactagtactttaccctccgtaccccggtagttccgcgaaacgggtaccaaggtagaaaactacgaaagacgaacgtgtacggctacgcacaatctgtctnacttcgtccac

SEQ ID NO: 437534 - DNA, 536 bp, Homo sapiens
  misc_feature: GZ8MTXP02FQ5TT.13.38.D05.1.454.CMB.2.raw
  modified_base (342)..(342): a, c, t, g, unknown or other
  modified_base (532)..(532): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagattagccagtctccatccaccctgtctgcgtctctcggagacagggtcaccatcacttgtcgggcaagtcagaacattggcaactctttaaaattggtatcagcagaagtcagggcaagccccgaactcctgatctacggtacatccactttgcacagtggactccatcaaggttcagtgcagtanatcaggaacagtacttttcccacaccatcgaggggtctacagcctagaagtattttgacgtacttactatttacgtacaaactagtacgttaccttccgtaccccggacgttccggacgaacggacgaaggtagaagtaacaacgcgaaacgtcgtacgctcgacactatctcgtctacgtactctaccnctac

SEQ ID NO: 437535 - DNA, 517 bp, Homo sapiens
  misc_feature: GZ8MTXP02IM01D.13.38.D05.1.454.CMB.2.raw
  modified_base (362)..(362): a, c, t, g, unknown or other
  modified_base (387)..(387): a, c, t, g, unknown or other
  modified_base (395)..(396): a, c, t, g, unknown or other
  modified_base (400)..(400): a, c, t, g, unknown or other
  modified_base (436)..(436): a, c, t, g, unknown or other
  modified_base (438)..(438): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaaacaataagaaacttcttaagcttggtaccagcaagaaaccaggacagcctctaaagctgctcattactgggcatctatccgggaaatccggggtcccctgaccgattcagtgcngcggtctgggacagatttcactctnaccatcannagcngcagcgagaagagtagtgtgtagttattactgtcananaatattaatatactactcgacgctctacgttcggtacggacggacgaaggtaggacgatacgaaacgtaacgtacgtcg

SEQ ID NO: 437536 - DNA, 577 bp, Homo sapiens
  misc_feature: GZ8MTXP02IB7XL.13.38.D05.1.454.CMB.2.raw
  modified_base (317)..(317): a, c, t, g, unknown or other
  modified_base (363)..(363): a, c, t, g, unknown or other
  modified_base (370)..(370): a, c, t, g, unknown or other
  modified_base (380)..(380): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtggggcgaggagggccaccatcaactgcaagtccagccagagttgtttatacagctaccaaacaataagaacttctagcttggtaccagacagaaaccaggacagcctctaagctgctcatttacngggcatctagtccgggaatccggggtcccctgaccgatcagtggcngcgggtnggggactagntttcactctcaccatcagcagcctgacaggctagaagagtgtggtctagtttataactgtacagtataaatttattaagtacgtaccttaccgtacggtacggtaccttaccgtaacgttttccggggaacgggtacgggaaccgtaaacggggttaggaacggtacgtaaaccgaaacggtaaacgtcggtaacgg

SEQ ID NO: 437537 - DNA, 540 bp, Homo sapiens
  misc_feature: GZ8MTXP02FIJJ3.13.38.D05.1.454.CMB.2.raw
  modified_base (345)..(345): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagccccgaacctcctgatctacggtacatccactttgcacagtggatcccatccaaggttcagtggcagtagntctggaacagatttaccctcaccatcaggggtctacagcctagaagtattttgcgtacttactattgtacaacagacgttaccttctcccccggagttcgccgtaacggaaccgaaggtacggaaagtacaaagacgtaactacgtaggtcgtcgacaccaacgtctacgttcttactactaccttcccgtaccc

SEQ ID NO: 437538 - DNA, 557 bp, Homo sapiens
  misc_feature: GZ8MTXP02FYDA3.13.38.D05.1.454.CMB.2.raw
  modified_base (316)..(316): a, c, t, g, unknown or other
  modified_base (340)..(340): a, c, t, g, unknown or other
  modified_base (343)..(343): a, c, t, g, unknown or other
  modified_base (348)..(348): a, c, t, g, unknown or other
  modified_base (360)..(360): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactctttaaatggtatcagcagaagtcagggcaacgccccgaactcctgatctacggtacatccactttgcacagtggntccatccaggttcagtggcagtantcnggaanagtatttacccncactatcgagggtctacgagcctagagtatttgcgtacttactattagtacaaactagtacgttaccttacctaccccccggtacgttccggtacgaacggtaccgaaacgtagggaaaactacgaacgacgaacgtaggtacgtcgtacgacgtaccaacgtaccgtttcgtacttactacttccttacccgtacc

SEQ ID NO: 437539 - DNA, 639 bp, Homo sapiens
  misc_feature: GZ8MTXP02ILM5T.13.38.D05.1.454.CMB.2.raw
  modified_base (381)..(381): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggacaacttactttaaattggtatcagcagagtcagggcaacgccccgaactcctgactctacggtacatccactttcgcacaggttacggactccatccgaaggttcagtggacagtagatcgtaggaaactagtactttacccncacctagtcgacggggtcacgacgccgtagtaacgtattttgacgttacttactagttacgtaacaacgtagtacgtttacccttacccgtacccccggtacgttaccgggacccgaaacggggtaccctaaagggggttacgaaaacgttaccgaaaacggtccggaaacgtttacggacggtccgttacggaccctaccctaagttcccgttacggtttccttaacgtaccgtttaccccgttcccccgtaacccg

SEQ ID NO: 437540 - DNA, 566 bp, Homo sapiens
  misc_feature: GZ8MTXP02IPYU2.13.38.D05.1.454.CMB.2.raw
  modified_base (353)..(353): a, c, t, g, unknown or other
  modified_base (377)..(377): a, c, t, g, unknown or other
tcagtcacgtactacacgaccggtgctcgatttagtatctgatagttggggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggactaactctttaaattggtatcagcagaagtcgagggcaacgcccccgaactcctgactctacgtacatcctactttgcacagtggactcccatccgaaggttcagtggacagtantcgtaggaactagtactttacccnctacatcgaggtctacgacgctagtaagtactttagactacttactattagtacaacgtagtacgtttaccttccgtacccccggtagttaccggaccgaacgggaaccgaaggacgaaaacgtacgaacgacgtaactaggtcgacgtcgacactaacgtactcgttctactacttcccttcccgtac

SEQ ID NO: 437541 - DNA, 562 bp, Homo sapiens
  misc_feature: GZ8MTXP02FLSJ6.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgactctacggtacatccactttgcacagtgggatccatccaaggttcagtggcagtagatctagggaaacagtaacttttaccctacaccctatcgtaggggtctaacagccctagagtattttgcgtacttacttacttgtacaacagtacgttaccttcgtcccccggtacgttcggaccgaacggaaccgaacggtaggaaaagtacaaacgacgaaacgtacggtacggcgtcgacgaccaagtactcgtctctactccgttccgtaccc

SEQ ID NO: 437542 - DNA, 499 bp, Homo sapiens
  misc_feature: GZ8MTXP02FGVZO.13.38.D05.1.454.CMB.2.raw
  modified_base (344)..(344): a, c, t, g, unknown or other
  modified_base (417)..(417): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattgacaaatatgtaaattggtatcaacagaagccaggtgaagcccctaagctcctgatctatactgcatccactttgtcaggcggggtccatcaaggtccgtggcagtggntcgtgggacagatttcactctcacatcacagtctgcaacctgaagactgtgcaaacttactaactgaccaaanacgtacttaacggaacctcgtacacttttggcctacggggaccaggctggagactacaaacgactgtagctgcacactctcg

SEQ ID NO: 437543 - DNA, 598 bp, Homo sapiens
  misc_feature: GZ8MTXP02F216X.13.38.D05.1.454.CMB.2.raw
  modified_base (291)..(291): a, c, t, g, unknown or other
  modified_base (320)..(320): a, c, t, g, unknown or other
  modified_base (380)..(380): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtccaccatcacttgtcgggcaagtcaagaacattggacaactctttaaattggtatcagcagagtcaggcaagccccgaacctccngatctacggtacatccactttcgcaacgngtgggactccatccaagttccagtggacagtagatcgaggaaacagtactttttaacccnctaacctatacgaggggttcctaacgagaccctagaaagtacttttcgggactacttactagtttcgtactaaacagttacgtttaacccgttccgtaccccccggtacgttccggaccgtaacgggaaccgaacggtaaaacgaaacgttaacgaacgtaacgaacgtacgtacgtcgtacggcaaccaactcttctctctacgtccttcccgtacc

SEQ ID NO: 437544 - DNA, 557 bp, Homo sapiens
  misc_feature: GZ8MTXP02FWZMM.13.38.D05.1.454.CMB.2.raw
  modified_base (342)..(342): a, c, t, g, unknown or other
  modified_base (363)..(363): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggcaactctttaaattggtatcagcagaagtcaggcaagccccgaactcctgatctacgtacatccactttgcacagtgggatcccatccaaggttcagtggcagtagntctggaacagtacttttaccncaccatcaggggtctacagcctagaagtattttgcgtacttactattggtacaacgagtacgtttaacccgttccgtacccccggtacgttcggtacccggaaacggaaccgtaaaacggtacggaaaactacgaaaaggacgaaacgtacggtggcgtacgcaccaatctcgtcttacactccgttcctaccc

SEQ ID NO: 437545 - DNA, 614 bp, Homo sapiens
  misc_feature: GZ8MTXP02JM6MO.13.38.D05.1.454.CMB.2.raw
  modified_base (465)..(465): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtggggggtccctcagactctcctgtgcaacctctggattcatttctctgacgcctggttgagctgggtccgccaggcgtcccgggaggggctgggaggtggggttggccgtagttaaaaggtagaaagacagtggtcggaacaacacgactacgagtcgttcccgtagaaaggcagattcgaactatctacaaagagattagactacaaaagaaatagataatatcgtaanaacaaatacgaaacaacgtaagaaaacgacggaacgaacacggaggtacgttacgtaacttacgtacgaaccaacgaggacgtcggacagacgtacgaacgaagtcggaccgacggtacgtacggtaccggaaccggtacggggcgggg

SEQ ID NO: 437546 - DNA, 580 bp, Homo sapiens
  misc_feature: GZ8MTXP02JX51F.13.38.D05.1.454.CMB.2.raw
  modified_base (349)..(349): a, c, t, g, unknown or other
  modified_base (399)..(399): a, c, t, g, unknown or other
  modified_base (413)..(413): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagacattggactaactcttaaattggtatcagcagaagtcgaggcaacgccccgaactcctgatctacgtacatccactttgcacagtggactcccatcccgaaagttcagtggcagtagntctaggaactagtacttttacccgacacctatacgaaggggtcctaacgngtccctagaacgtnttttacgacgtactttactagttgtacaactagtacgttaccgttccgtccccggtacgttccggaccgaacgggtaccgaaggtacgaaactacgaaaacgacggtaaacgtcggtacggtcgacgcgaaccaattcgtactcttacactttcccgttaccgaccc

SEQ ID NO: 437547 - DNA, 661 bp, Homo sapiens
  misc_feature: GZ8MTXP02JVR4Y.13.38.D05.1.454.CMB.2.raw
  modified_base (141)..(141): a, c, t, g, unknown or other
  modified_base (250)..(250): a, c, t, g, unknown or other
  modified_base (264)..(264): a, c, t, g, unknown or other
  modified_base (345)..(345): a, c, t, g, unknown or other
  modified_base (401)..(401): a, c, t, g, unknown or other
tcagtcacgtactacacgaccggtgctcgatttagtatctgatagttggggtttgggggagctacaacaggcaggcaggggcagcaagatggtgttgcagacccaggtcttcatttctctgttgctctggatctctggtcncccgacggggacatcgtgatcgacccagtcctccagacctcccgtggctgtgtctcgtgggcgaggacggccaccatacaactgacaagtccagccaagtgttgtttanacagcctaccaaanaaataacgtacttctagcttaggaccagacaacgaaaccgaggacacggcccctacgtaacgcgtgcctactagtttccgngggctacgtccgtaagtaccccggggaacgttcccggggtaccccctagacccgtnttcgaggtcgacgtacggggtcgggtacgtacggggactagttactttaccacccgttcctaccgtaaccctactacgacgaccgacgtcccgtacgaccgaaggtccgtaaggtaaggtacgtgggttacggtacttaaggtttactacgtggtactaggtaacttaatacgttataacgttcctacggacgtagtccctacgtacggttcgggacgggtacggaacgaaggtgaacgtacaaccgtacgtacgtgacg

SEQ ID NO: 437548 - DNA, 591 bp, Homo sapiens
  misc_feature: GZ8MTXP02HK4ZD.13.38.D05.1.454.CMB.2.raw
  modified_base (280)..(280): a, c, t, g, unknown or other
  modified_base (494)..(494): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtgggggtccctcgagactctcctgtgcaacctctggattcattttcnctgacgcctggttgagctgggtccgccgaggccgtcccggggaagggcgtggagtgggttggccgttaagtaaagggtagaaaggacagtggtacggaacaacgagactacgagtcgttcccgtagaaaacggcaagtacttcactattcacaagagatgaacacaaaaagaattagaataactaatctgaacaaaatgaaacaactagaaaancgagaaccagaggcgtagaacttacagaaccacagtacgacgggaccaggtaacacgaacaagcggcgacgtacgtacgtacgaacgtacggcgggg

SEQ ID NO: 437549 - DNA, 718 bp, Homo sapiens
  misc_feature: GZ8MTXP02IE078.13.38.D05.1.454.CMB.2.raw
  modified_base (233)..(233): a, c, t, g, unknown or other
  modified_base (261)..(261): a, c, t, g, unknown or other
tcagtcacgtactacacgaccggtgctcgatttagtatctgatagttgggtttgggggagtcagtctcagtcaggacacagcatggacatgagggtcccccgctcagctcctggggctcctgctactctggctccgaggtgccagatgtgacatccagatgagccagtctccatccaccctgtctgcgtctctcggagacagggtcaccatcacttgtcgggcagtcagaacnttggctaactactttaaattggtatcancagaagtcagggcaacgcccccgaacctcctgactctacggtacatcctactttgaccacgaggtacggacttcccatccgtaaaggttcagtcggactagtagattcgtaggaaacctagttaaccttttaccccataccctacgttacggacggggttacctaacgacgtcccgttagtaacggtttattttacggaccttactttaacttattttcgtaaccgtaaacttacggttaaccgtttacccgtttacccgttaccccccggggtaacgttttccgggacccgttaaaacgggggaacctaaacgggggtttaaccggaaaaacgttaccggaaaacggtaccggtaaaacgtttcggggtaacggtccgtacggtacccaacccgttaacttcccggtttacgttaccctttaccggtaccttttacccgtttacccccgtaccccg

SEQ ID NO: 437550 - DNA, 717 bp, Homo sapiens
  misc_feature: GZ8MTXP02H360K.13.38.D05.1.454.CMB.2.raw
  modified_base (246)..(246): a, c, t, g, unknown or other
  modified_base (259)..(259): a, c, t, g, unknown or other
  modified_base (296)..(296): a, c, t, g, unknown or other
  modified_base (316)..(316): a, c, t, g, unknown or other
  modified_base (332)..(332): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgagacgggccaccatacaactgacaagtccagccagtagttgttttaanacagctaccaaanaataacgacttctagcttaggaccagacaagaaaccnggaacagacctactaagccngactactaatttacgngggactatcgtaacgtacccggggaaacgtcccggggtaccccctaggtaacccgtatttacgaacggttggggacccagggtccgggggtttacagggggaacctaagggttaactttcaccttacccgtaccaaacctaggtaccaaggacaacggtacccgtacgacgacggtacgtaagaaagtagtaggtacggttacgttaacgtttaacgttacgttacgtacgtaacgtaactaaattaaacgtttaacgtaacgttaaccgttaccgtaccggtaccgtacgttaccgttaccggttaccgggtaccgggtaacgggtaaacggtaaacgggtaacggtaacgtaacgtaaacgtaaacgtaacggtacggtacgg

SEQ ID NO: 437551 - DNA, 584 bp, Homo sapiens
  misc_feature: GZ8MTXP02GADEW.13.38.D05.1.454.CMB.2.raw
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctccgtgggaggacagtcacactcacttgtggcttgagatacggctcagttctactagtagttacctaccccagctggtaaccaacacgaccccaggccaggcctccgcgcacgctcactctacaacaacaaacacctcgtactcttcgtcggggtccctcactcgtcttctctcgctcctatccgttaggaacaagctcgtcccttatcacgtcgaccgggggcccaagggacaagaagaatagaactctagtattagttacttgttagtttactttagtagttggtagtgtacttagttctgtcttgtaggttcgggtaggacggtccgacccggacgtccggtaccgtccgtcggtccgtacggacccgtacggccgtaccggacccc

SEQ ID NO: 437552 - DNA, 567 bp, Homo sapiens
  misc_feature: GZ8MTXP02HWYOH.13.38.D05.1.454.CMB.2.raw
  modified_base (197)..(197): a, c, t, g, unknown or other
  modified_base (341)..(341): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgtcgggcaagtcagaacattggcaactctttaaatggtatcagcagaagtcaggcaagccccgaactcctgatctacgtacatccactttgcacagtggactccatccaagttcagtggcagtagntcgaggaaacagtaactttacccacacctatcgaggggtctacgacgcctagaacgtattttcgacgtacttaactatttgtactaacgtagtactttacccttacccgtacccccgggtacgttcggaccgaacgggaaccgaaacggtaggaaacgtacgaaacgacgaacgtaggtcgacgtacgacactaatcgtacgttacttctactcctttacccgacc

SEQ ID NO: 437553 - DNA, 556 bp, Homo sapiens
  misc_feature: GZ8MTXP02FMODW.13.38.D05.1.454.CMB.2.raw
  modified_base (345)..(345): a, c, t, g, unknown or other
  modified_base (369)..(369): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatccaaggtcagtgcagtagntctaggaaacagtacttttacccncaccatcgaggggtctacagccctagaagtattttgctaacttacttaattgtacaactagtacgtttacccttaccgtcccccggtagttccggaccgaaacgggaacccgtaaggtaacggaaagtaacgaacgacgaaacgtagtagctacgcaccaatcgtctacttctacttctcccgtacc

SEQ ID NO: 437554 - DNA, 634 bp, Homo sapiens
  misc_feature: GZ8MTXP02JVE7P.13.38.D05.1.454.CMB.2.raw
  modified_base (244)..(244): a, c, t, g, unknown or other
  modified_base (322)..(322): a, c, t, g, unknown or other
  modified_base (370)..(370): a, c, t, g, unknown or other
  modified_base (453)..(453): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaaccatacaactgacaagtccagccagagttgtttanacagctaccaaacaataagaacttctagcttggtaccagcaagaaaccaggacagcctactaagctgctctattacgngggcatctagtccggaagtcccgggtcccctgacgtatcgagtggacngggcgggtcgtggggactaggtactttccacgttcctaccacccgtatcgacgccagccctagaccgtaggaccgtagaaagngttacggtacgggtactttaaggtttacttacgtacgttaccgataacgtaaattaagtttaacgtaacgttaccgttcccggtaccggtacgtaccgttacgttaaccggtttaccgggacgggtaacggaaccgtaagggtacggaacgtacgttaacgaaacgtaacgtcggtaacgg

SEQ ID NO: 437555 - DNA, 600 bp, Homo sapiens
  misc_feature: GZ8MTXP02FIFJE.13.38.D05.1.454.CMB.2.raw
  modified_base (403)..(403): a, c, t, g, unknown or other
  modified_base (439)..(439): a, c, t, g, unknown or other
  modified_base (528)..(528): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtgggggtccctcagactctcctgtgcaacctctggattcattttctctgacgcctggttgagcgtgggtccgccgaggccgtcccggggaaggggcctgggaggtggggttggccgtagttaaaaggtagaaagacagtggtcggaacaacagactacagtgttcccgngaaagggcagattcactatctacaagagatgactanaaaagaaatgaatatatctagacaaaatagaaaacaaccgtaagaaaacgacgaaaggaccagaggcgtagtaatacgtagtaacccanagatcgggaccaagactagacgtaaaagcgggaccacggaaccgaggttaccgaccgttacggacccggggg

SEQ ID NO: 437556 - DNA, 605 bp, Homo sapiens
  misc_feature: GZ8MTXP02HOI55.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactctttaaattggtatcagcagaagtcaggcaagccccgaactcctgatctacggtacactcctactttgacacgtaggtggactccctataccccgtaaggttcaggtcggacagttagctcgtaggaaacctagttaccttttacccacacccagtaccgaggggttctaacgacgtaccctagtaacgttattttcggacttacttacttaattcgtacaacgtagtacgtttacccttccgtacccccggtagtttaccggaccgaaacgggaccgaagggtacgaaaattcgaaacgtacgtaaacgtggttacgcgtacgaccacgtaacgttcgtacttctacctactccgtttccacc

SEQ ID NO: 437557 - DNA, 523 bp, Homo sapiens
  misc_feature: GZ8MTXP02FZT88.13.38.D05.1.454.CMB.2.raw
  modified_base (238)..(238): a, c, t, g, unknown or other
  modified_base (315)..(315): a, c, t, g, unknown or other
  modified_base (345)..(345): a, c, t, g, unknown or other
  modified_base (362)..(362): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaataagaacttcttagcttggtaccagcaagaaaccaggacagcctctaagctgctcatttacngggcatctatccgggaatccggggtccccngaccgattcgagtggcncggcgggtctggggacagtatttccactctcaccatcagcagcctgcaggctgaagatgtggctagtttatactgtacagacaatattatagtactcctcgagtctacacgttcggacggaggaccaagggtgaacgtactacgaaaacgacgtagtacgg

SEQ ID NO: 437558 - DNA, 601 bp, Homo sapiens
  misc_feature: GZ8MTXP02IT02U.13.38.D05.1.454.CMB.2.raw
  modified_base (384)..(384): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccaccatcacttgcggcaagtcagaacattggacaacttctttaaattggtatcagcagaagtcagggcaacgcccccgaactcctgactctaacggtacatcctatttgcacaggtggactcccataccgaaggttcagtcggacagtagatcgtaggaacctagtacttttacccgnaaccctatcgaggggtctacgagtcctagtacgtaagtttcgacgttacttaactagtttacgtaccaaacgttagttaacgtttacccgttcccgtacccccggttaggttacccggaccggaaacgggtaaccgaaggtaacggtaactacgaacgacgtaacgtcggacggtctacgcacgcttacgtcgttactctactcccttacccgtacc

SEQ ID NO: 437559 - DNA, 564 bp, Homo sapiens
  misc_feature: GZ8MTXP02H3M89.13.38.D05.1.454.CMB.2.raw
  modified_base (222)..(222): a, c, t, g, unknown or other
  modified_base (233)..(233): a, c, t, g, unknown or other
  modified_base (317)..(317): a, c, t, g, unknown or other
  modified_base (352)..(352): a, c, t, g, unknown or other
  modified_base (379)..(379): a, c, t, g, unknown or other
  modified_base (397)..(397): a, c, t, g, unknown or other
  modified_base (409)..(409): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtcaccatcacttgtcggnaagtcagaacnttggcaactctttaaattggtatcagcagaagtcagggcaacgcccccgaactcctagactctacggtacatcctactttgcanagtggactccatcccaaggttcagtggctagtagntcgtaggaacctagttactttacccanacccatcgagggtctacngctagtaagttntttgacttattactattgtacaagtagtacctttacccgtcccgtaccccggtacgtccggtacgaacgggtaccgtaaggtacgaaaactacgaaacgacgtaactggtacgcgtcgaccacctaagtctacgtcttacacttccgttacccac

SEQ ID NO: 437560 - DNA, 643 bp, Homo sapiens
  misc_feature: GZ8MTXP02FYO8T.13.38.D05.1.454.CMB.2.raw
tcagtcacgtactacacgaccggtgctcgatttagtatctgatagttgggtttgggggaggtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaacgccccgaactcctgatctacggtacatccactttgcacagtggactcccatccgtaaggttccaggtggactaggtagctcgtaggaaacgagtactttttacccacacctagtcgaaggggtcttaacgacgtaccttagaagttattttcggacgtaacttacgttagttgttaacaacgtagtacctttacccgttccgtaccccccggtagttcggaccgtaacggggtaaccaaacggggtaggtaaaactacggaaaacgtacggtaaaacgtaggttcgggaccttacggaccgaaacccgtaagtttaccttaacggttcctttacctaacgtttaccccttttccccggtaaaccccg

SEQ ID NO: 437561 - DNA, 647 bp, Homo sapiens
  misc_feature: GZ8MTXP02FSLLG.13.38.D05.1.454.CMB.2.raw
tcagtcacgtactacacgaccggtgctcgatttagtatctgatagttggggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcaccatcacttggtcgggcaagtcaagaactagttggactaaacttactttaaattggtatacagacaagaagtcgagggccaacgccccgaacctcctagactctacggtacatcctactttgcacgaggtaggactccccataccgaaggtttcgagtggactaagttagctcgtaggtaaacacgttaccttttaccctccaaacctagtacggtaacggggtacctaacgagtaccctagtaaagtattttacgaccgttaacttacgttattacgtaacaacgtagtaccgtttacccgtcccgtcccccggtacgttacggacgtaaacgggaccgaacgggtagaaacgtacgaaacggacgtaaacgtcggtacggacgtacggacctaccgtaacgttaccttgttaccctactaccttcctaccccgtcg

SEQ ID NO: 437562 - DNA, 673 bp, Homo sapiens
  misc_feature: GZ8MTXP02G02JF.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggttaagccgtgggggtccctcgagactctcctgtgcacctctggattctattttctctgacgtccgttggttgacgtcgtcgggtccgccgcggccgtaccccggggaaggggcgtgggaggtggggttcggaccgttaagttaaaggagaaagacgagtggtacgaacaacgagactacagtcgttacccgtagaaacggcagtacttacgacttatactacgaaagtagaattacggaaactaacgaaaaaagaaagtagtaaattaatactacgtacgaactaaaagttacgaaaacctaaccgtaaagaaaacggcggaaagaaccacggacggtacgtagttaacttaaccgtagtaacccgaagacgtagtaccgggacaaggacgtaggaactaaacgcggacccgacggtacgacggttacgacggttaccggaccggggg

SEQ ID NO: 437563 - DNA, 556 bp, Homo sapiens
  misc_feature: GZ8MTXP02I8IIK.13.38.D05.1.454.CMB.2.raw
  modified_base (239)..(239): a, c, t, g, unknown or other
  modified_base (318)..(318): a, c, t, g, unknown or other
  modified_base (368)..(368): a, c, t, g, unknown or other
  modified_base (386)..(386): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgtttanacagctaccaaacaataagaacttctagcttggtaccagcaagaaaccaggacagcctactaagctgctctatttacgngggcatctatccggggaatccggggtcccctgaccgtattcgagtcggcngggcgggtctaggggacngtatttcactctcaccatcagcagccctgcgaggactagaaacgtagtggtaggtacttagttttaataccgtgtacagactaattattactaagtactccgtacgagtccttactacggtttcggacggtaggacgtaaggtcgaagtactacgaacgtacgtagtcgg

SEQ ID NO: 437564 - DNA, 574 bp, Homo sapiens
  misc_feature: GZ8MTXP02FUKX6.13.38.D05.1.454.CMB.2.raw
  modified_base (236)..(236): a, c, t, g, unknown or other
  modified_base (308)..(308): a, c, t, g, unknown or other
  modified_base (460)..(460): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccaaccagatgtttanacagctaccaacaataagacttctagcttggtaccagcagaaaccaggacagcctcaagctgctcatttacngggctatcgttaactcccggggaaagtcccggggtaccctcggtaacccgtattccgaaggttcggaccagggtccggggtctgggggacctagtactttcactctacaccatcagcagcctgcaggcagagatgtagctagtttattacgngttacagtacaattattagtacgtactccgtacgtaggctacgtacgtttcgggacgggaacgggaccctaagggtggaacgtaacgttaccgaaaacgtacgtagtcgggacc

SEQ ID NO: 437565 - DNA, 695 bp, Homo sapiens
  misc_feature: GZ8MTXP02H0PMX.13.38.D05.1.454.CMB.2.raw
  modified_base (257)..(257): a, c, t, g, unknown or other
  modified_base (323)..(323): a, c, t, g, unknown or other
  modified_base (397)..(397): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgagagggccaccatcaactgacaagtccagccagtagttgttttatacagctacccaaanaataacgtaacttctagctggaccagcaagaacaggacacgcctactaagctcgctctatttacgnggctatctaacgtccggggaacgttcccggggacccctacggaccgtattcgaggtggccgaggggccgggttntacgggaactacggttactttaccacctttccctaaccaacccctaactaccgacgaccgtaccgtccgtacggacgacggtacgtaaggtaaagtggttacggttacggttaactttaaggttttaacttacggtacgttaacgaacgtaaataaatttaatttaacgtaaaccttacccgtacccgtacggtacggttccgttaaccgtacgggttaccgggggaacgggtaaacgggaaaccggtaaggggtacgaaaacgtaactaaaaccggaaacggtaacgttacgggacg

SEQ ID NO: 437566 - DNA, 537 bp, Homo sapiens
  misc_feature: GZ8MTXP02I4E1S.13.38.D05.1.454.CMB.2.raw
  modified_base (354)..(354): a, c, t, g, unknown or other
  modified_base (436)..(436): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggaccagcagaaaccaggacagcctctaagctgctcatttactgggcatctatccggaatccgggtcccctgaccgattcagtcggcngcgggtctgggacagtatttcgactctcgaccatcagcagcctgcagctgaagatgtggctagttatactgtcagctaaatnttaatagttacctaccgtcggagccttacgtacgtttccgggaccggacgggaaccctaaaggggtggaacgtacgttaccgaaaacgtaccgtaggtcgg

SEQ ID NO: 437567 - DNA, 570 bp, Homo sapiens
  misc_feature: GZ8MTXP02JIPOP.13.38.D05.1.454.CMB.2.raw
  modified_base (312)..(312): a, c, t, g, unknown or other
  modified_base (343)..(343): a, c, t, g, unknown or other
  modified_base (359)..(359): a, c, t, g, unknown or other
  modified_base (399)..(399): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttaacagctaccaacaataagaacttctagcttaggtaccagcaagaaaccaggacagcctctaagctgctcatttcngggtcatctatccgggaatccggggtccccngaccgattcaggtgcnggcgggtctgggacagtatttcacgtctcacatcagcacncctgcgagctagaacgatggtggtacgtagtttataacgtcgtacgagtactaaattattaagttacgtacctaccgttaccggacggtccttccgtaaccgtttcgggaccggtaacgggtaaccgaagggttacggaacgtacgtacgtaaaacggtacgtaaggtcgg

SEQ ID NO: 437568 - DNA, 579 bp, Homo sapiens
  misc_feature: GZ8MTXP02JE9U6.13.38.D05.1.454.CMB.2.raw
  modified_base (355)..(355): a, c, t, g, unknown or other
  modified_base (377)..(377): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagaacattggacaactctttaaattggtatcagcagaagtcagggcaacgccccgaacctcctgactctacggtacactcctactttcgcacagtggactcccatccgaaggttcagtcgcagtagntcaggaactagtactttacccncaccatcgaggtctacacgtctagagtattttcgcgtacttacttagtttgtactaaacgtagtaccgtttacccttcccgtacccccgggtacgttccggacccgtaacgggacccgtaaagggtacgaaagtacgaaacgcgaaaccgtgacggctacgcctaacaacgtcttacgtcctacacgtttccctcccgtacc

SEQ ID NO: 437569 - DNA, 549 bp, Homo sapiens
  misc_feature: GZ8MTXP02I8TKD.13.38.D05.1.454.CMB.2.raw
  modified_base (285)..(285): a, c, t, g, unknown or other
  modified_base (313)..(313): a, c, t, g, unknown or other
  modified_base (360)..(360): a, c, t, g, unknown or other
  modified_base (419)..(419): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccnggacagcctcctaagctgctcatttacngggcatctagtccgggaatccggggtcccctgaccgattcagtcgcnggcgggtctgggacagtatttcactctcaccatcagcagccctgccagggctgaaagtntggtgctagtttatactgtcagctaattattatagtactccgtacgacggtcttcgtaacgtttcgggacggtaacggggtaacccgaagggtggaaacgtacgtaacgaaaacggtaacgtggtaacgg

SEQ ID NO: 437570 - DNA, 662 bp, Homo sapiens
  misc_feature: GZ8MTXP02JMZVS.13.38.D05.1.454.CMB.2.raw
  modified_base (301)..(301): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccactcccaccctgtctgcgtctctcggagacagggtcaccatcacttggtcgggacaagtcaagaactagttggactaacttactttaaagttggtatcagcagaagtcgaggcaacgcccccgactccngactcgtacgtactactcctactttgacacgaggtggactcccgatacccgtaagggttcaggtcggacagttatagtcgtaaggaactagttaccttttaccccgacaacctagtcggtaacggggttacctaacgtacgtacccgtaggtacgttagttttcgaccttatttaaccttagttcgtaaccgaactacgtacccgtttacccgttcccgtacccccggtacggtaccggacgaaacggggtaaccgtaagggtaacgaaacgtcgaaacgacgtaaccgtggtaccggtacgtccgtacctacctaacgttccttacgttccttaccttccgttacccgttcccgtaaccg

SEQ ID NO: 437571 - DNA, 769 bp, Homo sapiens
  misc_feature: GZ8MTXP02HKBKU.13.38.D05.1.454.CMB.2.raw
  modified_base (243)..(243): a, c, t, g, unknown or other
  modified_base (256)..(256): a, c, t, g, unknown or other
  modified_base (333)..(333): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggcccacgatcaactgacaagtccagccagtagttgtttaanacagctaccaaanataagacttctagcttggacagacaagaaaccaggacacgtccctacgtaaagcctacgtactactaagtttaccgngggactacgttacgtaacgtccggggaaacttcccggggtcccctacggaaccgtagttaccgaaggttcgggactacgggggtccgggtacgttacgggggaacctaaggttacgttttacccgaaccgttaccgtacccgtaaaccccttaggtaccgtaaaccgggtacccgtaacgggtccccgtaggtaaccggtacgggggttacccttaaggtaaacgggtaacgtttcgggtacgggtttaaccttaagtttttaaaccggttacccgttagttacccggtaagtaaccttaaagttaacgtttaacgtaaccggtttacccttaccggttacccggaggttacccttacgtaaaccgggtttccgggaacgggtacggtaaccgtaagggtcgtaacgtacgtacgtaaaccgagtttcggtaacgg

SEQ ID NO: 437572 - DNA, 574 bp, Homo sapiens
  misc_feature: GZ8MTXP02G6MTO.13.38.D05.1.454.CMB.2.raw
  modified_base (289)..(289): a, c, t, g, unknown or other
  modified_base (349)..(349): a, c, t, g, unknown or other
  modified_base (373)..(373): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcgggcaagtcagaacattggcaactctttaaattggtatcagcagaagtcgaggcaacgccccgaacctcngactctacggtacatccactttgcacagtggactcccatccaaggttcagtggcagtagntcgaggaactagtacttttacccncaccatcgagggtctacgacgcctagacgtatttgcgttacttacttattgtacaactagtacgttaccttccgtcccccggtagttccggtaccgaacgggaccgaagggtacggaaactacgaaacgacgtaaaccgtggtacggcgtacgacctaccaacttcgttacgttaccttctaccttccgttcccctacccg

SEQ ID NO: 437573 - DNA, 541 bp, Homo sapiens
  misc_feature: GZ8MTXP02IRG78.13.38.D05.1.454.CMB.2.raw
  modified_base (415)..(415): a, c, t, g, unknown or other
  modified_base (419)..(419): a, c, t, g, unknown or other
tcagtcacgtactacacgaccggtgctcgatttagtatctgatagttgggtttggggtgggaagcctgggaacacttagccttcatgagtgtccccaccatggcctggatgatgcttctcctcggactccttgcttatggatcaggagtggattctcagactgtggtgacccaggagccatcgttctcagtgtctcctggaggacagtcacactcacttgtggcttgagatacggctcagtctctagtagttactaccccagctggtaccaacagaccccaggccaggctccgcgcacgctcatctacaacaacaaaacactacgctcttctcggggtccctcatcgcttctctgctccatccttgggaacaaagctacgtccctaatcaatcgacgggggcccaggcaggaaanatanatatatattattattgttagtttattattagtaggtagtagtctattctgtcgttgttggttcggtacggacggaccgaccgcgtacgtccgtccgtcgtacgacgaccgacgacgtcgccg

SEQ ID NO: 437574 - DNA, 618 bp, Homo sapiens
  misc_feature: GZ8MTXP02HMX2L.13.38.D05.1.454.CMB.2.raw
  modified_base (195)..(195): a, c, t, g, unknown or other
  modified_base (230)..(230): a, c, t, g, unknown or other
  modified_base (277)..(277): a, c, t, g, unknown or other
  modified_base (364)..(364): a, c, t, g, unknown or other
tcagtcacgtactacacgaccggtgctcgatttagtatctgatagttgggtttggggagtcagtctcagtcaggacacagcatggacatgagggtccccgctcagctcctggggctcctgctactctggctccgaggtgccagatgtgacatccagatgagccagtctccatccacctgtctgcgtctctcgganacagggtcaccgatcacttgtcggcaagtcagacntggcaatcttaaatggatcagcagaagtcaggcaagccccgaactcngatctacggtacatccatttgacacgtgtcggactcccgatccgaacgttcagtcgcaagtagctcgtagaactagtactttacccngtaccagtcgtagggtctaacgcgtacctagaacgttcgtttcggaccgttactttaacgtagttacgtaactaacgttacgtacgtttacccgttacgtacccccggtagttaccgaccggtaaaacgggaccgttaagggtacgtaaacgttaccgaaacgggtcgtaaaaccgtcggttacggtacgtacgtaccgtaaccgttaacgttcgtacggttacctcggtaacgtcccgtttacccggtacccg

SEQ ID NO: 437575 - DNA, 658 bp, Homo sapiens
  misc_feature: GZ8MTXP02HHKH5.13.38.D05.1.454.CMB.2.raw
  modified_base (393)..(393): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctctcggagacagggtcaccatcacttggtcgggacaagtcaagaactagttggactaacttactttaaagtggtatcagacaagaagtcgaagggaccaacgcccccgtaacctcctagacttaccgtaacggtaacctactcctactttgacacgtaggtcgggactccccatacccgaaggttcaggtcggactagtaagngtcgtaggaaactagttactttaccccgacacccgtagtcggtagggtacctaagtacgtaccgtagtaacgttagttttacgaccgttaacttacgttattcgtaactaacgtaagtaccgttacccttcccgtacccccggtacgtccggaccgtaaggaaccgtaagggtaagaactaacgaacgtacggtacgttacggtacggtacctacggccaacctaagttactcgttacctacgttaccttcccgttaccctaccg

SEQ ID NO: 437576 - DNA, 583 bp, Homo sapiens
  misc_feature: GZ8MTXP02FM9IA.13.38.D05.1.454.CMB.2.raw
  modified_base (291)..(291): a, c, t, g, unknown or other
  modified_base (350)..(350): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacagggtcaccatcacttgtcgggacaagtcagaacattggacaacttctttaaattggtatcagcagaagtcaggcaacgccccgaactccngatctacggtacatccactttgcacagtggactccataccaaggttcagtggcagtagntctaggaacagtactttacccacacctatcgtaggggtctaacacgtcctagaatatttagcgtacttactattcgtacaactacgtacgtttacccgttccgtaccccccggtacgttccggaccgaacgggaccgtaaaggtacggtaaagtacgaaacgacgaacgtacggtcggtacgtacgcaaccgtaactacgttacgttcttaccgtacttcccttcccgtaccc

SEQ ID NO: 437577 - DNA, 652 bp, Homo sapiens
  misc_feature: GZ8MTXP02FWJFH.13.38.D05.1.454.CMB.2.raw
  modified_base (238)..(238): a, c, t, g, unknown or other
  modified_base (325)..(325): a, c, t, g, unknown or other
  modified_base (383)..(383): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagcctaccaacaaataagtaacttcttagcttggtaccagacaagaaaccaggacagccctacctaagctgcctactatttacgngggcatctacgtaccgggtaaacgtcccggggtccccctgaccgtattcgagtcgcgngggtccggtcgtagggaccagtaactttcgaacttctacacctatacacgtcacgcctggcgtagggactgaaacggtgtggtacggtacgtttaagtttacgttaaccgtcgttacctaaggtaccttaaattatttaagtaccggttaaccttcccgtacggtaacggtcccttacgtaccggttttaccgggggaccgggtaacgggtaacccgaaggggttacggaaaggtacgttaaccgaaaaccggtaacgttggtaaccgg

SEQ ID NO: 437578 - DNA, 584 bp, Homo sapiens
  misc_feature: GZ8MTXP02GSX0R.13.38.D05.1.454.CMB.2.raw
  modified_base (241)..(241): a, c, t, g, unknown or other
  modified_base (289)..(289): a, c, t, g, unknown or other
  modified_base (320)..(320): a, c, t, g, unknown or other
  modified_base (381)..(381): a, c, t, g, unknown or other
  modified_base (458)..(458): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgacaagtccagccagtagttgttttanacagctaccaacaataagaacttctagcttggtaccagcaagaaaccnggacagcctactaagctgctactatttacgngggctatctaagtccggggaactcccggggtccccctaggaccgtatttcgaggttggacncgggtcggggtcttaggggacctagtacttcaacctctaccaaccactcacgtcacgccctgcgaggctaggaaagngtcggtaggtaccttaagttttacgtacgtgtacagtactaaattagttaatacgttacctaccgtcgacgtctacgtacgttcgggaccggaggacgaaggtgacgactacgaaactagtgtacg

SEQ ID NO: 437579 - DNA, 640 bp, Homo sapiens
  misc_feature: GZ8MTXP02GMKE2.13.38.D05.1.454.CMB.2.raw
  modified_base (244)..(244): a, c, t, g, unknown or other
  modified_base (325)..(325): a, c, t, g, unknown or other
  modified_base (382)..(382): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgaggagggccaccatcaactgacaagtccagccagtagttgttttanacagctaccaacaaataagaacttcttagcttggtaccagacaagaaaccaggacagcctactaagctgctctatttacgngggcatctacgtaccgggaaacgtcccggggtcccctgaccgtatacgagtcggcgngggcgggtcgtaggggactagtactttcgacttctaccacctactcgacgcgtacgccctgccgaaggcgtagaaagtacgtggtacggtacgttaagtttaagtttacgtcgtaccaaggtactaaaatttattaagttaacgttaacccttccgtaccgtacggtacctaccgttaaccggtttcggggacgggtaacggaaccgtaaggggtaggtaacgtaacgtaaacgtaaaaccggtacgtacggttacgg

SEQ ID NO: 437580 - DNA, 578 bp, Homo sapiens
  misc_feature: GZ8MTXP02GETZT.13.38.D05.1.454.CMB.2.raw
  modified_base (232)..(232): a, c, t, g, unknown or other
  modified_base (345)..(345): a, c, t, g, unknown or other
  modified_base (366)..(366): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggcggcaagtcagaacnttggacaactcttaaatggtatcagcagaagtcgaggcaacgccccgaactcctgactctaacggtacatccatttgcacgagtggactccatccgaaggttcagtgcagtantcaggaacagtactttacccncactatcgtagggtctaacgagccgtagaagttagtttcgacgtacttacttaagttcgtacaacgtagtaccgttaccttccgtacccccggtagtccggtaccgaacgggtacgaaacggtacgtaaacgtacgtaaacgacgtaaacgtaggttacggacgtacgacgaccgtaactcgtcgttacttacgacttccgtcccgtacccg

SEQ ID NO: 437581 - DNA, 685 bp, Homo sapiens
  misc_feature: GZ8MTXP02HY0RL.13.38.D05.1.454.CMB.2.raw
  modified_base (221)..(221): a, c, t, g, unknown or other
  modified_base (232)..(232): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagacagggtcaccatcacttggtcggnaagtcagaacnttggactaacttacttaaattggtatcagcagaagtcgagggacaacgcccccgtaaactcctagtactaccgtaacggtacactcctaactttgactacgaggtacggactccctataccgtaaggttcctaaggtggactaggtagacttaccgtaggaaacctagttaacctttttaccccacaaccctataccgaaggggttacctaacgacgtacccgttaagtaaacgttcgtttttaacgaccgttaacttttaaccgtatttaccgtacgtaaacgtagttaacgtttaccccgttacccgtacccccggttacggttaccggtaccgaaacgggtaaccgaaagggttaggaaaactacgaaacgacgtaaaccgtggtacgtaccgtcgtaccgaacctaaggttcctacggttccttaccgtacgttccctttaacccgccc

SEQ ID NO: 437582 - DNA, 656 bp, Homo sapiens
  misc_feature: GZ8MTXP02I0ZD0.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccaccatcacttgcggcaagtcagaacattggcaactctttaaattgtatcagcagaagtcagggcaagcccccgaactcctgatctacggtacatccactttgcactagtggactcccatcccaaggttccagtcggctagttagatctaggaactagtactttacccgacacctatccgtaaaggggtctaacgacgtcccgtagtaacgttagtttttacgaccgttaaactttaccttaaagtttcggttactaaaaccgttacgttaccgtttaacccgtttcccccgtaccccccggggttaacgtttcccggggacccgtaaaggggaaccccgtaaaggtaacgggaaaacttaaccggaacgtacggtaaaccgttaggtcgggccctagtacccgaccctaagttccttacggtccttacaccgttcctttccccgaaccc

SEQ ID NO: 437583 - DNA, 589 bp, Homo sapiens
  misc_feature: GZ8MTXP02GAN9U.13.38.D05.1.454.CMB.2.raw
  modified_base (197)..(197): a, c, t, g, unknown or other
  modified_base (233)..(233): a, c, t, g, unknown or other
  modified_base (317)..(317): a, c, t, g, unknown or other
  modified_base (378)..(378): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcgganacagggtcaccatcacttgcggcaaagtcagaactnttggacaactctttaaatggtatcagcagaagtcaggcaacgccccgaactcctgactactacggtacattccactttgaccanagtcggactccatccaaggttcagtgactagtagattcaggaaactagtactttttacccncaaccgtatcgtacggggttactaaccgagtacctagaagttatttcgacgtaacttatattgtaccaaagtagtactttacccttaccgtacccccggtacgttacgacggaaacggtaccgaaaggtacggtaaaactacgaaagacccgaaacgttggcggtacacgccgaacaacgtcctagtccttacaccttccttcccgtaacc

SEQ ID NO: 437584 - DNA, 645 bp, Homo sapiens
  misc_feature: GZ8MTXP02F7VJG.13.38.D05.1.454.CMB.2.raw
  modified_base (238)..(238): a, c, t, g, unknown or other
  modified_base (249)..(249): a, c, t, g, unknown or other
  modified_base (308)..(308): a, c, t, g, unknown or other
  modified_base (321)..(321): a, c, t, g, unknown or other
  modified_base (384)..(384): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttaanacagctacaanaataataacttctagtcttacggaccagacaacgaaaccaggacacgcctactaagctnctactaattacgngggactatacgtacgtaccgggtacgtcccggggtcccctacgaccgtattcgagtcggacgngggtcgggtacgtagggactagtactttaccacttcctaccaaccctatacgacgccgacgtcctacgacgtacgggtacgtaaggaaagtagtggtacggtacgttaagttttacttaccgtgtacagtacttaaattattaacgtacgttacccgtaccgtacggacgtacctacgttacggtttacggggaaccgggtaacgggaaaccggtaagggtacggaaacgtaacgtaacgtaaaacgtacggtcggtacgg

SEQ ID NO: 437585 - DNA, 553 bp, Homo sapiens
  misc_feature: GZ8MTXP02HZVTW.13.38.D05.1.454.CMB.2.raw
  modified_base (239)..(239): a, c, t, g, unknown or other
  modified_base (323)..(323): a, c, t, g, unknown or other
  modified_base (379)..(379): a, c, t, g, unknown or other
  modified_base (439)..(439): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccgacggggacatcgtgatgacccagtctccagactccctggctgtgtctctgggcgaggagggccaccatcaactgcaagtccagccagagttgtttanacagctaccaaacaataaagaacttctaagcttaggtaccagcaagaaaccaggacagcctacctaagctgctcaattttacgngggcatctaacgtcccggggaatcccggggtccccctgacccgattcgagtggacnggtcgggtctggggaacagtactttcacctctcaccatcagcagcctgcaggctgaaagntgtggctagtttatactgtacagataatattatagtactcctcgagcttacacgtttcgggacggagggaaccgtaaggggtcgaagactaacgaaaaccgtaacgtgtacggg

SEQ ID NO: 437586 - DNA, 646 bp, Homo sapiens
  misc_feature: GZ8MTXP02JMWLD.13.38.D05.1.454.CMB.2.raw
  modified_base (258)..(258): a, c, t, g, unknown or other
  modified_base (313)..(313): a, c, t, g, unknown or other
  modified_base (327)..(327): a, c, t, g, unknown or other
  modified_base (385)..(385): a, c, t, g, unknown or other
  modified_base (427)..(427): a, c, t, g, unknown or other
  modified_base (434)..(434): a, c, t, g, unknown or other
  modified_base (443)..(443): a, c, t, g, unknown or other
  modified_base (464)..(464): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggccaccatcaactgacaagtccagccagtagttgttttatacagtctaccaaanaataagaacttcttagcttggtaccagcaagaaaccaggacacgcctactaagcngactctatttacgngggacagtctagtccgggaacgttcccggggccccctgaccgtattcaggtcggacgngggtccgggtcgtcggggacaggtactttcactctacaaccntacgacncacgtcccngaccgaggtacaggtaaacgngtaggtacgggtacttaagggttttacttaccgtaggttaccaaggtaactaaagtttacttaagtaacgttaccgttaccgtaccggtacggtacccttacgttaacggtttccggggacggaaccgggtaaccggaagggtacggacgtaaacggtacgaaaaccgtacgtacggtacgg

SEQ ID NO: 437587 - DNA, 554 bp, Homo sapiens
  misc_feature: GZ8MTXP02FLR49.13.38.D05.1.454.CMB.2.raw
  modified_base (362)..(362): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagaacattggcaactcttaaatggtatcagcagaagtcaggcaagccccgaactcctgatctacggtacatccactttgcacagtggatcccatccaagttcagtggagtagatcgtggaactagtattttacccncacatcagggtctacagctagagatttgacgtacttactattagtactaaacagtagttaccttctacccccggtacgtccggtacgtaacggaccgaaggtacggaaagtaaccaagacgaaccgtaggttacggacgttcgaccgactaacgtaactcgttcttactaacttcctttacccccgacctac

SEQ ID NO: 437588 - DNA, 573 bp, Homo sapiens
  misc_feature: GZ8MTXP02IYM1T.13.38.D05.1.454.CMB.2.raw
  modified_base (367)..(367): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaatggtatcagcagaagtcagggcaagcccccgaactcctgatctacggtacatccactttgcacagtggatcccatccaaggttcagtggcagtagatctggaaactagattttacccncaccatcaggggtctacgagtcctagagtattttgccgtaacttactatttgtaccaaacgtagtacgtttaaccttccgtaccccccggagtttccgggacccgtaaaacggggacccgaaaagggttcggaaaacgttacgaaaacggacgaaacgtcgtagggctacgcacccaatcgtcgtacttctactccttcccgtacc

SEQ ID NO: 437589 - DNA, 654 bp, Homo sapiens
  misc_feature: GZ8MTXP02FW8D5.13.38.D05.1.454.CMB.2.raw
  modified_base (250)..(250): a, c, t, g, unknown or other
  modified_base (342)..(342): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatcgacccagtcctccagacctccctggctgtgtctcgtgggcgaggacgggccaccatcaactgacaacgtccagccagtagttgttttanacagtacctaccaaataaataacgtaacttcttagcttaggtaccagcaacgaaaccaggacacgcctacctaagctgcctactatttacgngggactattacgtaacggtaccgggtaacgtccccggggtacccctacggtaccgtattacgaggtcggacgtcggggtccgggtacggtacgggactagttactttccgaccttctacctaacctactaccgacgtccgacgtccctaggaccgaggtactaggaaagtagtggtacggtacgttagttttaagtacgtaggtacagtaacttaattagttaactacgtacctaccgtacgagtcctacgttacggttaccgggacgacggtaacgaaggtcgaaacgtactaacgaacgtacgtggtacg

SEQ ID NO: 437590 - DNA, 531 bp, Homo sapiens
  misc_feature: GZ8MTXP02G3FKX.13.38.D05.1.454.CMB.2.raw
  modified_base (314)..(314): a, c, t, g, unknown or other
  modified_base (360)..(360): a, c, t, g, unknown or other
  modified_base (388)..(388): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttatacagctaccaacaaataagaacttctagcttggtaccagcaagaaaccaggacagcctacctaagctgctcattacngggcatctagtccggaatccgggtcccctgaccgtattcgagtgcnggcgggtctgggacagtatttcgactcncaccatcagcagcctgcgagctagaaagatgtgtactagtttactactgtacagactaatattaatagtaacctcgtacgaggtctcgtacgttcggacggaggaccgtaaggtaggagtactacgaaacgtacgtagtacgg

SEQ ID NO: 437591 - DNA, 619 bp, Homo sapiens
  misc_feature: GZ8MTXP02G7KVE.13.38.D05.1.454.CMB.2.raw
  modified_base (356)..(356): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttggtcggcaagtcagaacattggactaactctttaaattggtatcagcagaagtcaggacacgccccgaacctcctgactctacggtacatcctatttcgacacgagtgggactcccataccgtaagtcagtggcagtacgngtcgtaggaactagtacttttaccactactacgtcgaacggggttctacgacgcccttagaagtacttttgaccgtacttacttaaagttcgtaactaaacgtagttacgtttaaccttcccgttaaccccggcggtttaccggaccggaacggtaaccgaagggtacggtaaaagtacgtaaacggacgtaaccgtaggtcggtactacggacctacgtaacttccgtcggttacttacgtacttccccgtacccggttccg

SEQ ID NO: 437592 - DNA, 776 bp, Homo sapiens
  misc_feature: GZ8MTXP02HJV4E.13.38.D05.1.454.CMB.2.raw
  modified_base (336)..(336): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccacctgtctgcgtctcgtacggagacgagggtcaccatccacgttggtcgggacaagtcagaactagttacggactaacttactttaaagttggtatcgagcaaggaagtcgacgggaccaaccgacccccgtaacctcctaggtactacgtacggtacnctacctacgtttcgactaacgaggtacgggtacctacccctagtaccccgtaacggttacgacggtcggactaggtaacgtcgttacggtaacggtaaacttacgttaacccttttaaccccgactaacccgtaagttccgggtaaacgggttacctaaccgtacggttacccgtaaggttaaacgttacgttttcggtaaccgtttaaactttacggttaacttacggtaacctaaacgttacggttacccgtttacccccgttaccccggttacccccgggtacggtttaccccgggaaccggtaaaacgggtacccggtaaagggtaaacggtaaacgttaacggaaaccggtaccggtaaacggtggttccggaactccggaaaccctactaagtttccggtctttaccttcgtacctttcccgttaccccgtacc

SEQ ID NO: 437593 - DNA, 717 bp, Homo sapiens
  misc_feature: GZ8MTXP02HB0YL.13.38.D05.1.454.CMB.2.raw
  modified_base (520)..(520): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtcctcagactctcctgtcgcaactctggattcacctttagtagctattggatgagcgtggtccgccgaggcctccgaggggaaggggcgtgggaggtggacggaccaaacgaataaacggcgtaaaggttaggaaagtggaaagtaaacttacgtaagtggtaggtacttcgttggtagggaacggggtcccgtaacttccgaacctagtcctacccgaaagacgaaacccaacgacccaaagaactcgaacttcgtatctagaacctaaaagtcgaaaccncggtacctagggaacggacgacccgggtaagaccgaccgggtacttacggttacttaaacgttaccgttgggttacggaccggaaagggttaagtaacgggggtttcggggggaaaaccgtttaaggtacgttaacgggaccgttaggggttcgggaaccctttaaacggggtttaacctttacggttttaaccggg

SEQ ID NO: 437594 - DNA, 584 bp, Homo sapiens
  misc_feature: GZ8MTXP02I47QS.13.38.D05.1.454.CMB.2.raw
  modified_base (238)..(238): a, c, t, g, unknown or other
  modified_base (317)..(317): a, c, t, g, unknown or other
  modified_base (369)..(369): a, c, t, g, unknown or other
  modified_base (383)..(383): a, c, t, g, unknown or other
  modified_base (455)..(455): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgaccccagtctccagactccctggctgtgtctctgggcgagagggccaccatcaactgcaagtccagccagagttgtttanacagctccaaacaataagaacttcttaagcttggtaccagcaagaaaccaggaccagcctctaagctagctcatttacngggcatctagtcccgggaattcccggggtccccctgaccgtattcagtggcnggcgggtctggacngtatttcactctcaccagtcagtccagcccttgctacgggctagaaagagtgtggctaaggtttattaacgngttcgaagtactaaatatttaatacgttaaccttcccgtacggtacgtcttacgtaaccgtttcgggacgggtaacggtaccgaaagggttcggaacgtacgttaccgaaaacggtaaccgtggtacgg

SEQ ID NO: 437595 - DNA, 687 bp, Homo sapiens
  misc_feature: GZ8MTXP02HOTGS.13.38.D05.1.454.CMB.2.raw
  modified_base (238)..(238): a, c, t, g, unknown or other
  modified_base (314)..(314): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctgctgtgtctctgggcgagaggccaccatcaactgcaagtccagccagacgttgttttanacagctaccaaacaataagaacttctagcttggtaccagcagaaaccaggacagcctcctaagctgctcatttacngggcatcgtagtccgggaatccggggtccccctgaccgtattccgagtcggctacggggcgggttcctaggggacctaggtacttttaccgacccttcgtaccctaaccctactaccacgaccaacgtcccttcggaccgtacggggaccttagggaaacgtagttggttacgggttacgttaaggttttaactttacgttaacggttccaaggtacctaaaagtttaattaacgttaacggttaaccttcccggtaaaccccggtgggttacccttacgtacccggtttttacggggaccgggttaaacgggtaacccgtaagggggtttacgtaaggacgttaaaccggaaaacgtaaccggttaggtcgg

SEQ ID NO: 437596 - DNA, 577 bp, Homo sapiens
  misc_feature: GZ8MTXP02H7NQX.13.38.D05.1.454.CMB.2.raw
  modified_base (372)..(372): a, c, t, g, unknown or other
  modified_base (410)..(410): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggttaagccgtgggggtccctcgagactctcctgtgcaaccttctggattctattttctctgacgccttggttgagcgtggtccgccgaggccgtccgggaagggcgtggagtgggtggcgtaagtaaggtagagacatgacgacaacngactacagtcgtcgagaagcagtatcatatctacaagngatgactaacaaaagaatagaataatatactagaacaaatacgaaacaaccgtaaagaaacgaggaacgacaacgaggcgtagtatactcgtaacgacagagtcggacctaggactacggaacaagtcggacgacgacgtacggtaccgacgtacgggtaccggggg

SEQ ID NO: 437597 - DNA, 581 bp, Homo sapiens
  misc_feature: GZ8MTXP02JTL01.13.38.D05.1.454.CMB.2.raw
  modified_base (239)..(239): a, c, t, g, unknown or other
  modified_base (295)..(295): a, c, t, g, unknown or other
  modified_base (328)..(328): a, c, t, g, unknown or other
  modified_base (468)..(468): a, c, t, g, unknown or other
  modified_base (523)..(523): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagcctaccaaacaaataacgtaacttcttagcttaggtaccagcaacgaaaccnggacagccctactaagctagctactatttacgnggctatctagtccggggaacgtccggggtccccctggaccgtattccgaggtcggcgtagggccggggtctaggggaactagtactttccaccttctacctaccaatcgaagccgacgtccctgaccgaggctagaaagnttggtgtacgttagttttatactgactagactaattattatacgtactccgtcgngtctcgtacgttcggacggtacggacgtaaggtgagactacgaaacgtacgtgtacgg

SEQ ID NO: 437598 - DNA, 524 bp, Homo sapiens
  misc_feature: GZ8MTXP02FMTHU.13.38.D05.1.454.CMB.2.raw
  modified_base (313)..(313): a, c, t, g, unknown or other
  modified_base (362)..(362): a, c, t, g, unknown or other
  modified_base (369)..(369): a, c, t, g, unknown or other
  modified_base (376)..(376): a, c, t, g, unknown or other
  modified_base (442)..(442): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaacaataagaacttctagcttggtaccagcagaaaccagacagcctcctaagctagctcatttacngggcatctatccgggaatcccggggtcccctgaccgattcgagtggcgngcgggtntgggacngtatttcactctcaccatcagtcagcctgcagacgtagaagagtgtggtactagtttagtatcgtnagtacaattatatacgtactcctcgagtctctacgttcggacggacggtacgaaggtcgaagactacgaaacgactgtacgg

SEQ ID NO: 437599 - DNA, 623 bp, Homo sapiens
  misc_feature: GZ8MTXP02IKVSN.13.38.D05.1.454.CMB.2.raw
  modified_base (240)..(240): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagtagttgttttanacagcctaccaaacaataaacgtaacttctagtcttacggtaccagacaagaaaccgaggaccacgcctacctaagctgcctctatttacgtgggctatcgtagtaccggaacgtccggggtcccctcgaccgtatcgtagtcggcagggcgggtcgtgggactagtacttcactctcaccatcagcagcctgcgtagctagaagtactgtacgacctaacttacctactacgaaccaaacgttacgttaccgttaaccggtaacctcgttaactttaccggtttacgggacccggtaacggggacctaacgggccgtaggtaacgtaacgtaaaccgtaaaacggtaacgtttcgggacgtaccgttacggaccctaacccg

SEQ ID NO: 437600 - DNA, 627 bp, Homo sapiens
  misc_feature: GZ8MTXP02J2JC1.13.38.D05.1.454.CMB.2.raw
  modified_base (347)..(347): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcagacattggacaactctttaaatggtatcagcagaagtcagggacaacgccccgaacctctgatcgtacgtacatccactttgacacagtcggactccatccgaagttcagtgacagtagntgtaggaacagtaactttacccactacccagtacgaggggtacctaacgacgacctagaagtacgttttacgaccgttactttaacgttatttacgtacctaaacgtgttaaccgtttacccgttaccgtacccccgggtacgtttacgggacccgtaaacggggtacccgaaaagggttacgggaaaacttacggaaacggtacgtaaaccgtggttaacggtcgacggtaccgacctaacttacgtcgttaccttctaccgtacctttcccggaaccc

SEQ ID NO: 437601 - DNA, 734 bp, Homo sapiens
  misc_feature: GZ8MTXP02JO6FC.13.38.D05.1.454.CMB.2.raw
  modified_base (294)..(294): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacttggtcgggcaagtcagaacagttggactaacttctttaaatggtatcagcagagtcgagggcaacgccccgaacctccngtactcgtacggtacacgtaccctactttcgactaacgaggtacgggactcccctagtacccgtaaggtttcaaggttggacgtaaggtacgtagtcgtaaggaaacgttacgttaacttttacccctactacctacgtcggtaaggggttacctacgtaacgtccgtaggtaagtacgttttacgaccgttactttaacgttaagttacgtaactaaacgtaacgttacccgtttaaccccgtttacccgtaacccccgggttacgggttacccggtaacccgggtaaaaccgggtaacccggtaaaacggggtaacggtaaaacgttaacggaaaacggtaccggtaaacggttacggtcgggtaccgttacggaccctaaccggtaacttacggttacgttaccttacgtaccctttacccggttccccgttaaccg

SEQ ID NO: 437602 - DNA, 529 bp, Homo sapiens
  misc_feature: GZ8MTXP02FWPY1.13.38.D05.1.454.CMB.2.raw
  modified_base (237)..(237): a, c, t, g, unknown or other
  modified_base (312)..(312): a, c, t, g, unknown or other
  modified_base (413)..(413): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccaaccagagtgtttanacagctaccaacaataagaacttctagcttggtaccagcagaaaccaggacagcctcctaagctgctcatttacnggcatctagtccggaatccggggtcctgaccgattcagtggcaggcgggtctggggacagtatttcactctcacatcagcagcctgcaggctagaagatgngctagtttatactgtacagcaattatatagtactctacgaggctctacgttcggacggtacgggaccgtaaagggtaaggaacgaacgtacgaaaaccgtagtacggtacggtacg

SEQ ID NO: 437603 - DNA, 756 bp, Homo sapiens
  misc_feature: GZ8MTXP02IFME0.13.38.D05.1.454.CMB.2.raw
  modified_base (203)..(203): a, c, t, g, unknown or other
  modified_base (216)..(216): a, c, t, g, unknown or other
  modified_base (231)..(231): a, c, t, g, unknown or other
tcagtcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtcctccttccaccctgtctgcgtctggtggganacagagtcattancacttgccggcactntagtttgtggtaggtgttgtctggtatcagacaaagccaggcaacgacccctaaatcctagacttcgtttagacggtcgttacgttaacgttttaagggaacggggtactaccgttaccgaaccccgtaagggtttaccgacggtccggtacccagggtacggtaacgttcggtaggggaaccaaggtacctttacccgaaacccccgttaccaaaccccgtaactacccgaaaacaaccggtcccgttagacccgaacggtaccctaggtaaaaccgtacccttacgtacgtaaacccttaaaccgtttaaccttaacttacggttaaacctaaaccggtaacgttttaaaattaaaaccttttaacgtttaaaactttaaccgttaaccgtttttagggaacccgtaaacgggggtaaaccctaaagggtacgggtaaataacgtaaacgaaaacggtaacttaggacggtactacgacctacctaattcgtacgtacttacgtaccttacccgttcccgaac

SEQ ID NO: 437604 - DNA, 537 bp, Homo sapiens
  misc_feature: GZ8MTXP02HOP4D.13.38.D05.1.454.CMB.2.raw
  modified_base (314)..(314): a, c, t, g, unknown or other
  modified_base (351)..(351): a, c, t, g, unknown or other
  modified_base (373)..(373): a, c, t, g, unknown or other
  modified_base (426)..(426): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacgggacatcgtgatgacccagtctccagactcccctggctgtgtctctgggcgaggagggccaccatcaactgcaagtccagccagagttgttttatacagctaccaaacaataagaacttctagcttggtaccagcagaaaccaggacagcctactagctgctcattacngggcatctagtccgggatccggggtcccctgaccgtnttccgagtcggcacggcgggtnggggacagtactttcactctacacatcagcagccctgcaggctagaagtgtgnggtactagtttatacgtgtacagtataatattatagtacctcgacgagtactcgtacgttcgggacggacggaccgaagggtcgaagtacgtacgaaacgtagttcgacgg

SEQ ID NO: 437605 - DNA, 758 bp, Homo sapiens
  misc_feature: GZ8MTXP02IFI23.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacgagggtcaccatcacgttggtcgggacaagtcaagaactagttcggactaacttacttttaaaagttggtaatacgtagaccaaggaaaggtacgaagggtaccaaaccggacccccgtaaaccctcctagtacttaccgtaaccggtaacacttaccctaactttcgacctaacgtacgggttcggggaaccttccccgtaattaacccgtaaacgggtttccgagggttacgggacgtaaggttagacttacgtaagggaaacttacgttaaccgtttttaccccactaacccgattaccggacggggttacctacgacgtacccgttaggtaacgttattttacggaccgtaactttaactagtttaccgtacaacgttaagtaccgtttaccgttacccgttaccccgggtaccgttaccggaccgtaaaccggggaaccgtaacgggtaaagaaaacgtacggaaaacgtaccggtaaacgtggtaacggtcgtacggtaccctacgtaacgttcgtactttaccgttactaccttccgtttaccccgtaaccg

SEQ ID NO: 437606 - DNA, 646 bp, Homo sapiens
  misc_feature: GZ8MTXP02GEDEI.13.38.D05.1.454.CMB.2.raw
  modified_base (290)..(290): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcggcaagtcaagaacattggacaacttctttaaattggtatcagcagaagtcgaggcaacgccccgaactccngactctacgtacatccactttgcacgagtggactccccatcctaaacggttcaaggtcggacaggtatagtcgtagggaaactacgtacttttacccacacctatcgagggtctacgagtcctagagttatttacgacgttacttactattacgtactaaactacgtacgtttaacccgttccgtacccccggtacggtttaccggaccgtaaacggggtaaccgaaacgggtacgtaaaacgttaacggaaacgtaccggaaaccgttaaggtcggtaccgttacggacccgtaccaacgtttccgttacgtttaccgtttaccgttaacctttaccccgttcccggttaacccg

SEQ ID NO: 437607 - DNA, 671 bp, Homo sapiens
  misc_feature: GZ8MTXP02HWO4L.13.38.D05.1.454.CMB.2.raw
  modified_base (241)..(241): a, c, t, g, unknown or other
  modified_base (273)..(273): a, c, t, g, unknown or other
  modified_base (297)..(297): a, c, t, g, unknown or other
  modified_base (578)..(578): a, c, t, g, unknown or other
  modified_base (626)..(626): a, c, t, g, unknown or other
  modified_base (648)..(648): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggctggttaagcgtgggggtccctnagactctcctgtgcactctggattcatttctntgacgcctggttgagctgggtccnccgaggccgtccccggggaagggctggacgtggggttggaccgtagttaaaggtagaaagtacgaagtcggtacgggaacaacgacgtaacctacgtagtcggtttccccgttaggaacggtcgtaaggtacttacgaccttatacctttaacgaaagtaaggattacggaactaacgaaaaaggtaaaattagaaattaactaataccttagaacgaaaattaggaaacctaaacccgttaagaaaacggacccggaagggaacccaagtacggacggtntaacgttacctagttacccaagttacgagtacggcgaagagttacganaacggtaagcccgacggtacgngttacccgagtaccggtacgggg

SEQ ID NO: 437608 - DNA, 558 bp, Homo sapiens
  misc_feature: GZ8MTXP02I0WR9.13.38.D05.1.454.CMB.2.raw
  modified_base (285)..(285): a, c, t, g, unknown or other
  modified_base (298)..(298): a, c, t, g, unknown or other
  modified_base (307)..(307): a, c, t, g, unknown or other
  modified_base (310)..(310): a, c, t, g, unknown or other
  modified_base (341)..(341): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacaggtcaccatcacttgcggcaagtcagacattggactaacttacttaaattggtatcagtcagaagtcaggcaacgccccaactcngactcgtacgacntcctacttncanagtggactccatccagttcagtggcagtagntcgagaactacgtactttaccacacctagtacgtacgggtcacgagtcctagtacgttatttacggactacttacttagttacgtacaacgtacgtaccgtttaccctcccgtacccccggtagttaccggacgaaacgggaccgtaagtacggtaaactacgacgacgtaacgtcgcgactacgacactaactcgtcttactctactcgtccctac

SEQ ID NO: 437609 - DNA, 681 bp, Homo sapiens
  misc_feature: GZ8MTXP02GPKD5.13.38.D05.1.454.CMB.2.raw
  modified_base (485)..(485): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcggtgggggggcttggttaaggccgtgggggtccctcgagactctcctgtgccaacctctggattctatttctctgaccgtccgttggtgacgtcgtcgggtccgccgacggcccggtccggggaaggggcgtgggaggtggggttggcgtaagttaaaaggtaggaagacgtagtggtacggacaacgacgactacgtagttcggttacccggtagaaaacggcgtaagtacttacaacttactacgtacgaaagtagaattacgaacctaaaanaaaaaggtaaatacgaattaactaatctagaaaccaaatacgaaaactaaccgtaagaaaacggacgaaacgacaacgaggcgttaagtactacgtacgtaaccagacgacgtacggaccagtacgtacaacgtaaaggccggaccgaacggtaccggtaacggtttacggaaaccggttcggggaaccccggggg

SEQ ID NO: 437610 - DNA, 668 bp, Homo sapiens
  misc_feature: GZ8MTXP02IJNXN.13.38.D05.1.454.CMB.2.raw
  modified_base (257)..(257): a, c, t, g, unknown or other
  modified_base (275)..(275): a, c, t, g, unknown or other
  modified_base (281)..(281): a, c, t, g, unknown or other
  modified_base (432)..(432): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgcttattttaaaaggtgtccagtgtgaggtgcaagtggtggagtcgtgggggggcttggttaagccgtgggggtccctcagactctctgtncactctgattctatttcnctgacnccgtggttgagcgtggtccgccgaggccgtaccggggaggcgtggagtgggtgacgtaagtaaggtagaagactagtggtacgaacaacacgactacgagtcgtaccgtagaacgcaagtactcactatctacaaagagtatagaactaanaaaaagtaatagtaattaatatcgtagaactaaaataacgaaacctaaaccgtaaagaaaaccggcggaaaacgaccaacggtaacggtacgttaagttaaactttacgtaacggtaaaccaacgtaacggtaacggtacgggaaaccgaagtaacgtacgaaacgtaaaacggtccgggaccgaaccggtaaacggtacggttacccggtaaacgttaccggggtaacccggggg

SEQ ID NO: 437611 - DNA, 694 bp, Homo sapiens
  misc_feature: GZ8MTXP02GZKF1.13.38.D05.1.454.CMB.2.raw
  modified_base (400)..(400): a, c, t, g, unknown or other
  modified_base (483)..(483): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgagggtcaccatcacgttggcgggacaagtcaagaactagttcggactaaacttactttaaagttggtaatcgagacagaaagtcgaaggggaccaaccgacccccgaacctcctagacttaccgtaacgtacactcctactttcgacacgaggtcggactccaagtaccgtaaggttcaggttcggacgtaagtaacgngttacgtaaggaaactagttaccttttaacccactaaccgtacgtacggacgggttactacggacgtaccgtagtaaacgttntttacgacttacttacgttattacgtaacaaacgtagttacctttacccgtacccgtacccccggtagttaccggaacgtaaacgggaccgtaagggtaaacgaaacgtacgaaacggtaacgtaacggtacgttaacggccgttacggaacctaacgtcttccggttaacgtttccttaacctaccgtttaacccgttccccgttaaccg

SEQ ID NO: 437612 - DNA, 726 bp, Homo sapiens
  misc_feature: GZ8MTXP02GNLA9.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacgagggtcaccatcacttggtcggcaagtcagaacattggcaacttcttaaatggtatcagacagaagtcaggacaacgccccgaactcctgactctacgactactactacctagtcactacgtaggacggtacctactactaacggtacgtagtacggtcgaacgtagtacgtactacggtaaacgtacgttaactttaccctttaccaacctaaaccgtgtaccggggtaacggtaccctaaggcccgttacggaagttaagtttcggtacctaaacttacctttaggtacttacaaccgtaaacgggtacctttacccggttttaaccccgcccccggtaaccgggtttccgtaaacccgggaaaacggtaaaccccggaaaagggttacgggaaaacgttaaaaccggaaaccgttacggaaacccgttaaaggttcgaccgacggttcccaaaacccccgtttaagtcccttaaggtttccttaaccccttactaaccccgggttttccccgtaaaaccccc

SEQ ID NO: 437613 - DNA, 643 bp, Homo sapiens
  misc_feature: GZ8MTXP02JE1F0.13.38.D05.1.454.CMB.2.raw
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggggcttgggttaacggcccggggggtccctcgagacctctcctgtgcaacctctggattcatttctctgacgcctggttgagcgtgggtccgccgaggccgtccccggggaaggggctgggaggttggggttggccggtaagttaaaggtagaagacagtgggtacgacaaacgacgacctacgagttcgttcccgtaggaaaacggcagtattcacgttactctacgaaagagatgaactaacaaaaagaatgaattactatctagacaaaatagaaaccaaacgtagaaaacgacgaacgggaacaacggagggtacgtagttaacttaaccgacgtaaacccaagacgaggtacgggaccagtacacgacaagtcggaaccgacggaacgtacgtacgacgtacggggacggggtaacccgg

SEQ ID NO: 437614 - DNA, 883 bp, Homo sapiens
  misc_feature: GZ8MTXP02HB6WJ.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggagacgaggtcaccatcacgttgtcgggacaagtcaagaacagttggactaacttctttaaagttggtatcagcagaagtcgaagggaccaacgacccccgaactcctagtactccgtaacggtacctacgtccctaacgttttcgacgaacgtacggtacgggtacctcccccgtaagtaccccgtaaagggtttccgaagggttacggaccgttaaacggttaagtacgtttaccgtaaacggggtaaaacccgttaacggttttaacccctttttaaacccccctaccgtaaaaccccgttaacgttacccgggtaaacgggggtttacccaaacccggtacggtaccccgtttaaaggtaaacggtttacgttttttaccgggaaccgtttaaaccttttaaacccggttaaattttccggttaaaccgtaaaaccgtttaaacggttaacccggtttttaacccccgtttacccccgggttacccccccgggggttaacggtttaccccggggtaaacccggtaaaacccgggggtaacccgtaaacgggggtttaaacgaaaacggttaccgaaaacggtaccggtaaaaccgtggggttaccggtaccgtaccggaccgtaaacctaacgttaccgttcggttacccttacgtaccctttaccccggtttccccgtacccg

SEQ ID NO: 437615 - DNA, 728 bp, Homo sapiens
  misc_feature: GZ8MTXP02H6EMB.13.38.D05.1.454.CMB.2.raw
  modified_base (185)..(185): a, c, t, g, unknown or other
tcagtcacgtactacacgaccggtgctcgatttagtatctgatagttggggtttgggggagtcagtctcagtcaggacacagcatggacatggagggtcccccgctcagctccgtggggctcctgctactctggctccgaggtgccagatgtgacatccagatgagccagtctccatcccacctntctgccgttctcgtcggagacgagggtaccaccatctacgttggtcgggacaagtacaagaactagttacggactaacttactttaaagttgtatacgagacgaaggaacgtacgacgggacaaccgacccccgaactccgtagtactccgtaacggtactactcctactttgactagtaggtacggactaccgagtacccgaaggttccgaggtacggtactaaggtacgtagtaccgttaaggaaacctttacggtttaaaccctttaccgaacctaccgtaacgttaccggaggggtttaacccacgtaaacgtcgttaagttaaacgttcgttttacgacgtttactttacgtagttcgttaacaagttaccgttaccgtttaccctcccgggttaccccggtaacggttaccggaccgtaaaacgggtaacccgtaaagggttacgaaaacgtacgaaaacggtccggaaagtcggtacgacgttacgcctaaaccttcgtacgttcgttacctactacccgttacccgttcccaccg

SEQ ID NO: 437616 - DNA, 686 bp, Homo sapiens
  misc_feature: GZ8MTXP02HKJXL.13.38.D05.1.454.CMB.2.raw
  modified_base (240)..(240): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacagggtcaccatccagttggtcgggacaagtcaagtaacngttggactaacttcgtttaaattggtatcagacaagaagtcgaagggacaacgcccccgaactcctagactacgtacggtacactcctacgtttgaccagaggtcggactacccgtatacccgtaaacggtttcaaggtcggtactaaggttagacgttcgtaacggaaacttaccgttaacctttttaccccacgtaaaccctagttacgtaacgggggtacctaacgacgtaccgtagtaaacgttgttttacgacgttacttacttattacgtacaacgttacgtaccgtttaccttccccgtacccggtcgttaccggaccggaaacgggaccgtaagggtaacggaaacttacgaaacggacgttaaccggtagggtacgtcgtaccgacccgtactaaccgttcgtacggttcctaccgtaccttcccgtttacccgccc

SEQ ID NO: 437617 - DNA, 651 bp, Homo sapiens
  misc_feature: GZ8MTXP02JSBXG.13.38.D05.1.454.CMB.2.raw
  modified_base (227)..(227): a, c, t, g, unknown or other
  modified_base (372)..(372): a, c, t, g, unknown or other
  modified_base (394)..(394): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgcgtctcgtcggagacgagggtcaccatcacgttggcgganaaggtcagaactagttcggactaacttactttaaatggtatcagcagagtcgaggcaacgacccccgaactccgtgactacgtacggtacactcctactttgacacgaggtacggactccagtaccgacggttcagtgacagtantcgagaactagtactttacccncgacagtacgaggtctacgacgtaccgtagtacgttacgtttcgaccgttaaactttacgttagttcgtaaacaacgttaacggttacccgtttacccctttacccccggtacccccggtaacgggtttacccggaaccggtaaaccgggaaccggtaaagggtacgaaaacgttaccgaaacggtacggtaaacggtggtaacggtcgacgtaccacctgtcttacgttacttcctaccgttacccttcccgaacc

SEQ ID NO: 437618 - DNA, 640 bp, Homo sapiens
  misc_feature: GZ8MTXP02IL9U1.13.38.D05.1.454.CMB.2.raw
  modified_base (237)..(237): a, c, t, g, unknown or other
  modified_base (239)..(240): a, c, t, g, unknown or other
  modified_base (246)..(246): a, c, t, g, unknown or other
  modified_base (249)..(249): a, c, t, g, unknown or other
  modified_base (252)..(252): a, c, t, g, unknown or other
  modified_base (256)..(256): a, c, t, g, unknown or other
  modified_base (260)..(260): a, c, t, g, unknown or other
  modified_base (295)..(295): a, c, t, g, unknown or other
  modified_base (308)..(308): a, c, t, g, unknown or other
tcagtcacgtactacacgaccggtgctcgatttagtatctgatagttgggtttggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagaggccaaccatcaactgcaagtccagccagatgtttananncacaanaanaanactntagntagacagacaagaaacagacacgcctactaagctnactactattacgnggtacatactaacgtaccgggaacgtcccggggtcccctagaacccgtattaccgaaggtcggacgacgggtccgggtacgtaggggaactagtactttaccacttcctaccaaaccctaagtacacgacgacgccgtacgacgacggtacgtagaaagtaagtaggtacggtacgttaagtttaacgttaacgtagtacgaagtaactaaattaaattaaattaacgttaacctaccgtaccgtacgtaccgtacgtacgttaccggtacggaacggaaacggtaaacggtaacggaaacgaacgtaaacgaaaacgtaaacgtacgtacg

SEQ ID NO: 437619 - DNA, 641 bp, Homo sapiens
  misc_feature: GZ8MTXP02GQOIF.13.38.D05.1.454.CMB.2.raw
  modified_base (279)..(279): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcggtggggggggcttggttaagccgtgggggtccctgagactctctgtcgcacctctggattctatttcnctcgacgtcctggttgagcgtcggtccgccgaggccgtacccggggaagggcgtgggaggtggggttcggaccggttaagtaaaacggtagaagacgtagtcgggtacgaacaaacgacgtaactacgtagtcggttacccgtaggaaaggtcaagtacttacgaacttatctacaaagaacgtataggaactaaacgaaaaagaatagaatatagtctagaacaaaaggtacaaaacaactaaggaaaacgcggaagaacaggaaggtcgtagtacttagcgtaacaacgagagtcggaacaggtaacacgaacgtacggcggaccgacggacgtacgtaccggacggtacgggaccgggg

SEQ ID NO: 437620 - DNA, 721 bp, Homo sapiens
  misc_feature: GZ8MTXP02I75JG.13.38.D05.1.454.CMB.2.raw
  modified_base (339)..(339): a, c, t, g, unknown or other
  modified_base (388)..(388): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatcccaccctgtctgccgtctcgtcggagacgaggtccaccatcacgttggtcggactaagtcaagaactgttggactaacttactttaaagtggtatcgaagcaagtaagtcgagggaccaaccgcccccgaactcagtactccgtacggtactactcctactttnacacgtggtcgacctccagtacccgtaagttcgaggtcgacgtagtacngtcgtaaggaaactacgttacctttaccacaccgtagtacggtacgggttacctacgacgtaccgttaagtaaacgtttacgtttacggaaccgttactttaacttaacgtttacggtaacctaaaaccgttagtttaacccccgttttacccgttaccccccggttacccccgggtacggttacccggaaccggtaaacggggtaacccggtaaagggtaacggtaaaacgtacgaaaacgggtaccgtaaacggtttcggacgtacgtaccaccgaaccgttcgttacttccggttacttacccgtaccgtttcccgtttaccccgtaccg

SEQ ID NO: 437621 - DNA, 672 bp, Homo sapiens
  misc_feature: GZ8MTXP02GL58B.13.38.D05.1.454.CMB.2.raw
  modified_base (303)..(303): a, c, t, g, unknown or other
  modified_base (401)..(401): a, c, t, g, unknown or other
  modified_base (453)..(453): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctctcggagacagggtccaccagtcacgttggtcgggacaagtcaagaactgttcggactaacttacttttaaagttggtatcaagcagaagtcgaggcaacgccccgaactcngatctacggtacactctactttgacacgagtcggactccctataccgtaaggtcagtcgacagtacgctcgtaggaaactacgttacttttaccccanaaaccctagtaccggtaacgggtcctaaacgacgtacccgtagaaacgtttnttttacggacttacttacgttagttcgtaaccaagttacgttaaccgtttaccccgttaccccgacccccgggtaacgttcgggaaccgtaaacggggtaccgtaaagggttacgaaaacttcgaaaacggttccgaaacgttcgggtagtacccgtagccgtaaaccgtaactttcggttacgttacctttaccacgtttaccccgtccccggtaacc

SEQ ID NO: 437622 - DNA, 670 bp, Homo sapiens
  misc_feature: GZ8MTXP02I7RMO.13.38.D05.1.454.CMB.2.raw
  modified_base (280)..(280): a, c, t, g, unknown or other
tcagtcacgtactacacgaccggtgctcgatttagtatctgatagttgggtttggggctgggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtgggggtccctcagactctcctgtgcaacctctggattcattttcnctgacgcctggttgagtcgtgggtcccgccgagggccgtccccggggaaggggcgtgggaggttggggttggccgttaagttaaaaggtagaagacagtggtcggaacaacagactacgagttcgttcccgagaaagccagtattaccactatactacgaaagagtatagaaccttaagaaaaagtaaatagattaaattacttacgtagaactaaaagttacgaaaaccaaacccgttaaaggaaaaacggcggaaacggaacctaacggaacgggtcgtttaaggttactttaaccacggttaacccaacgaggtagttcggggaccaagtacgtacgaacaaaggtcggacgacggtacgtagtacccgaggtaccggtaccggggg

SEQ ID NO: 437623 - DNA, 684 bp, Homo sapiens
  misc_feature: GZ8MTXP02IJV0X.13.38.D05.1.454.CMB.2.raw
  modified_base (246)..(246): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccgacggggacatcgtgatcgacccagtctccagactccctggctgtgtctcgtgggcgagacgggccaccatcaactgacaagtccagccagtagttagttttanacagactaccaaataataaacgtaacttcttagtcgttaggtaccagacaaacgaaaccgaggaaccacgtaccctacgtaacgcgtgtacctactacgtttacgtcgggactataccgttacgtaccgggtaacgtcccggggtaccccctaggtaccgtatttacgaggtcggccgtaggggtccggggttcgagggggacctaagtcgtttccactctacaccgtatacgagccgacgtccgtggtacgacggtcttaaggaaaacggtgtttaacgggcgggttactttaaggttttactaacgttgtaccgagttaactaattattactacgtacttccgtacgtcggtaccttacgttacggttccggggaacggacggtaacgtaacggggtacgaacgtaacgtaaacgtaaaccggtagtacgggtacg

SEQ ID NO: 437624 - DNA, 609 bp, Homo sapiens
  misc_feature: GZ8MTXP02GHI6S.13.38.D05.1.454.CMB.2.raw
  modified_base (201)..(201): a, c, t, g, unknown or other
  modified_base (380)..(380): a, c, t, g, unknown or other
tcagtcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtggganacagagtcattatcacttgccggcactcagtttgtggtaggtgtgtcctgtatcagacaaagccgaggcaacgcccctaaactcctgactcgttgaggtcgtacttacgtttaggaacggggatctcgacccaggttcacggcggccctagtggtatacgtgggactagactcaccctnacccatacacacgcctgcagctagagactctacgactaacttactactacgtacaatacgtaattaactactttaattacgtacgtttacggaccggtaacgggtaaccaaggtaggaagtaacgtaacgaaaccggtaaatacggtacggttacctacggaacctaaccttaacgttaccgttaacgtttccgtttacctaaaccgtttcccttaaccccgtttaccg

SEQ ID NO: 437625 - DNA, 654 bp, Homo sapiens
  misc_feature: GZ8MTXP02HNEC8.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccggggtgccagatgtgacatccagatgagccagtctccatccaccctgtctgccgtctcgtcggagacagggtcaccatcacttggtcggacaagtcagaacagttggactaacttctttaaagttggtatcagcagaagtcaggcaacgccccaacctctgatctacggtacagtcctacttgacacgagtgggactccaatcgaacggttcagtggactagtacgatcgtaggaaactacgttactttaaccctacaccgtaatcggtacggggtcctaacgacgtaccgttagaaagttacgttttcgacgttacgtttaactacgtttagtacccaaagtacggttactttaccccgtttaccccgtacccccggttacgttccggaaccgtaaccggggtaccgtaaagggacggtaaaattaaccggaaacggaaccggtaaactcggttacggacctacggacctacgtaacttcgtacttaccgttacctacctaccgttcccgtaccttacg

SEQ ID NO: 437626 - DNA, 694 bp, Homo sapiens
  misc_feature: GZ8MTXP02GMIY7.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtccaccatccacttggtcggacaagtcaagaacattcggactaaacttactttaaagttggtatcgagcaaggaagtcgaacggggaccaaaccggcccccgtaaactccctagactccgtacggtacactcctactttcgactacgtaggtcggactaccctagtaccgtaacggttcaggtcggtacgtaagtagactcgtaaacgggaaactacgttaacctttacccactaacctagtccggtaacggggtacctaacgacgtccgtagtaaacgtttagtttcggaccttaaacttacttacgttacgtaacctaacgtaagttaccctttacccgttcccgtacccccggtaggttaccggtaccggaaaccggtacgtaaacggtacggtaaactaacgaacgtacggtaaacgtcggtacgtacgtcgactaaccgtaacttaccgttacttacctacctcccttaaccgtttccctaccg

SEQ ID NO: 437627 - DNA, 596 bp, Homo sapiens
  misc_feature: GZ8MTXP02J16FT.13.38.D05.1.454.CMB.2.raw
  modified_base (283)..(283): a, c, t, g, unknown or other
tcagtcacgtactacacgaccggtgctcgatttagtatctgatagttgggtttggggctggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtggggggtccctcgagactctcctgtgcaacctctggattcattttcnctgacgcctggttgagcgtgggtccgccgaggcgtcccgggaggcgtggaggtggtggccgtagttaaaggtagaagacagtggtacgacaacgacgactacagtcgttccgagaaaggcagtacttcgactatctacaagagtatacgactaacaaaaagtaatagatataactctagactaaaagtgaaaccaacgtagaaaagccgaaggacacgaaggtcgtagtacttacgtagtacccacgagtacgacgggaccaggactacggaacaaagtcggacgacgacgtacgtcgacgtacggaccgggg

SEQ ID NO: 437628 - DNA, 609 bp, Homo sapiens
  misc_feature: GZ8MTXP02GFX88.13.38.D05.1.454.CMB.2.raw
  modified_base (317)..(317): a, c, t, g, unknown or other
  modified_base (352)..(352): a, c, t, g, unknown or other
  modified_base (374)..(374): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacttgtcggcaagtcagacattggcaactctttaaatcggtatcagcagatcgagggacaacgccccgaacctccgtgactcgtaacggtacatccactttgcanagtggactcccatccaaggttcagtggacacgtantcaggaaactagtactttaccncacatcgagggtcacacgcgtagaagttatttagacgtacttactattagacaacgtagtacgttaacccttcctacccccggtacggtttccgaccgtaaacgggacccgaaagggtacgaaaagtaccgaaacgtacggtaaaaccgttagggtcgggtacttacggaccgtaaaaccgtaaccttacggtcgtttaccgtttccgaacgtttcccttacccggttaaccccg

SEQ ID NO: 437629 - DNA, 613 bp, Homo sapiens
  misc_feature: GZ8MTXP02IMYKN.13.38.D05.1.454.CMB.2.raw
  modified_base (242)..(242): a, c, t, g, unknown or other
  modified_base (326)..(326): a, c, t, g, unknown or other
  modified_base (381)..(381): a, c, t, g, unknown or other
  modified_base (502)..(502): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccaagtagttgttttanacagctaccaaactaataagtaacttcttagcttaggaccagacaagaaccaggaccagcctacctaagctgctctatttacgngggctatctagtccgggaacttcccggggtccctcggacctattccgagtcggcnggggcgggttcgaggggacagtactttcactcctacactagtcagcagccctgcgaggctagaaacgtgtcggtaggtaccttaaggttttactaccgtgtactaaggtacttaaaagttntttactaacggttacccttaccgtacggtacggtaccttaccgttacggtttccgggggaacggttacgggaactaaggggtgtaaacgactaacgaaacgtacgtgtacg

SEQ ID NO: 437630 - DNA, 722 bp, Homo sapiens
  misc_feature: GZ8MTXP02IDXVV.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccacctgtctcgcgtctcgtcggagacgagggtcacatctacgttggcggacaagtcaagaactagtcggactaacttactttaaagttggtatacagacaagtaacgtcgaggaccaacgaccccgaactcctagactacgtaacggacactcctatttgactacgagtcggtactacccgtatacccgtaaagttaccgtaggtaggtactaaggttaagcgttacgtaacggtaaactacgttaacccttttacccactaacccgtacgttaccggaaggggtttaccaacggtacgtaccgtagtaaacgtttacgtttaccgaaccgtttaacctttaaacgttacgtttaaacggtaaaccttaacggttaaacgttacccgtttaaccccgttcccccggtaaccgggtaccggttaccggaacccggtaaacgggaaaccgtacggggaaacgtaaaacgtacgaaacggtacgtaacgtggtacgtcgtaccgactaccgtaacttcgtacgttctaccgtaccttcccttaaccgtcc

SEQ ID NO: 437631 - DNA, 716 bp, Homo sapiens
  misc_feature: GZ8MTXP02GRCGC.13.38.D05.1.454.CMB.2.raw
  modified_base (242)..(242): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgacaagtccagccagtagttgttttanacagctacaaacaataagaacttctagcttaggtaccagacagaaacctaggacacgcctactaagctagctcgatttacgtcgggcagtctacgtccgggaaagtcccggggtacccccttacggaccgtaagttccgtaaggttcggacgtacgggccggggttacgttacgggggaacctaagggttaaccgttttccaaacccgtttcccgttacccgaaaacccgttcgtaccaaacggtacccaaacgggtacccccttggaccccgaaaggggtccttaacgggtaaaacgggtagttacggtacgttacgttaacggttttacttaccgtacgtacgtacgtaactaaagttaagtttaacgtaccgttaccttaccgtaccgtaggttacctacggtaccgttacgggacggaacggtaacgtaacgggtgtaaacgtacgtaaacgtaacggtacgtacgtacg

SEQ ID NO: 437632 - DNA, 519 bp, Homo sapiens
  misc_feature: GZ8MTXP02JXA5X.13.38.D05.1.454.CMB.2.raw
  modified_base (201)..(201): a, c, t, g, unknown or other
  modified_base (234)..(234): a, c, t, g, unknown or other
  modified_base (342)..(342): a, c, t, g, unknown or other
  modified_base (345)..(346): a, c, t, g, unknown or other
  modified_base (478)..(478): a, c, t, g, unknown or other
  modified_base (487)..(487): a, c, t, g, unknown or other
  modified_base (517)..(517): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccacctgtctgcgtctctcggagaccgngggtcaccgatcacttgtcggacaagtcagacnttggctaacttcttaaatggtatcagcagagtcaggcaacgccccgaactccagactccacggtacactccatttgacatggtggactccataccgagttcagtgacnganncgtagactgtactttccacactatcgtaaggtctaagcgtctaggatactttcggacttacttagtattcgaccagtagtacttcctacgtccccgtaggttcgaacgtacggactaaggtcaatcgaagtnacgtgcgcncgacactgtctacgtctcgaccttcctacncg

SEQ ID NO: 437633 - DNA, 698 bp, Homo sapiens
  misc_feature: GZ8MTXP02JDWG9.13.38.D05.1.454.CMB.2.raw
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacgagggtcaccatcacgttgcgggcaagtcaagaacattggactaacttactttaaattggtatcgagcgaagaacgtacgaggacaaccgccccgtaactcccagtactaccgtaacggtactactccctatttacgactacgtagggtcggtactaccgtactaccgtaacggttcaggtcggctaaggtagtacgtccgtaaggaacttaacgttaccttttaaccccactaacccgtacgttccggtaaggggttacctacgacggtcccgttaagtaacggtttcttttaacgggaccttaacgttactttaaagttcgtaaacctaacgttacgtaacccgtttcccgttaaccccggtcccccggtacggttaacccggtacgaaccgggaaaccgtaacgggtagaaaacgtcgtaacgaccgtaacgtcggtacgccgtacgccaaactcgttacgtacgtacttccgtacttacccgttccctaaccg

SEQ ID NO: 437634 - DNA, 768 bp, Homo sapiens
  misc_feature: GZ8MTXP02FOFM9.13.38.D05.1.454.CMB.2.raw
  modified_base (288)..(288): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtccaccatcacttgtcgggcaagtcaagacattggcaacttctttaaatggtatcagcagaagtcagggcaacgccccgaactcngatctacgtacatccactttgcacgagtggatcccatccaaggttcaggtcggactaggtagcgtaccgtagggtaaaacctacgttaaacctttttacccccacgtaaacccgtaacgttacccgggtaaacgggggttacccttaaacgaacggttaccccgttaagggtaaaaggtttcgtttttaacggacccggttaaaccgttttaacctttaagttttaaacggtaacccttaaaaccggttaaacggttaacccggtttttaacccccggtttaccccggtttaaccccccccgggggttaaggtttttaccccgggaaacccgggttaaacggggtaaaccccgggaaaaggggttacggggtaaaaccttaacggaaaacggtaccgtaaaaccggttggtaccggttcgtacggaccaccctaaggttccttaacggtcctttacccgtaccgtttaccccgacgtacg

SEQ ID NO: 437635 - DNA, 682 bp, Homo sapiens
  misc_feature: GZ8MTXP02HBRP9.13.38.D05.1.454.CMB.2.raw
  modified_base (245)..(245): a, c, t, g, unknown or other
tcagtcacgtactacacgaccggtgctcgatttagtatctgatagttgggtttgggggagctacaacaggcaggcaggggcagcaagatggtgttgcagacccaggtcttcatttctctgttgctctggatctctggtcgcccgacggggacatcgtgatgacccagtctccagactccctggctgtgtctcgtgggcgaggacgggccaccatacaactgcaagtccagccagtagttgtttanacagctaccaaacaaataaagtaaccttcttaagtcttaggtaaccagacaacgaaaccaggaccacgccctaccgtaaagctcgtacctactaagtttacgtgggctaataccgttaacgtaccccggggaaacgttcccgggggttaccccctacgggaaccccgtagtttaccgaggtcggacgtacgggggtccgggttacgtcgggggaaccaaggttactttcaaccgttctaccaacctatcaacggcacggtccagacgacggcgtaagaagtagtggtaggttacgttaagttttataccgtgtactaagtaactaagttacttaagttaacgtcctaccggtacgtacggtccttacgtacgttcggggaccgggtaacggaccgtaaagggtggaactaacggactaaaaccggtagtcgtacggg

SEQ ID NO: 437636 - DNA, 688 bp, Homo sapiens
  misc_feature: GZ8MTXP02F5MG2.13.38.D05.1.454.CMB.2.raw
  modified_base (426)..(426): a, c, t, g, unknown or other
  modified_base (673)..(673): a, c, t, g, unknown or other
tcagtcacgtactacacgaccggtgctcgatttagtatctgatagttggggtttgggggagtcagtctcagtcaggacacagcatggacatgacgggtccccgctcagctccgtggggcctcctgctactctggctccgaggtgccagatgtgacatccagatgagccagtcctccactccaccctgtctgcgtctcgtcggagacgaggtcaccatctacgttggtcggactaagtacaagaactagttacggactaaacgttacttttaaatggtaatcgagacaaggaactacgagggacaaccgcccccgtaaacgtcctgtaactcgtaacgtacctacttaccctctttagcgactacggtacgtgtaccctaaccagttaaacggtacgttaggacggtcggaaacttagtaccggtanaccggtaaagaaccgttactttaacccttaccgaacctaacgtcgtaacgggtacgtaactaccgtcgttaacggtactaagttttgtaccgacctttaaagtacgtttaacgacgtaactaagtaacgtttaacccttcccgtacccccgtacgtacggtacccgtaacggaaacggtaaacgaacgtaaaacgaggtaaaacgtacggactacggagtcgacgactacctaatcgtcttacctcncttaccgccgttacc

SEQ ID NO: 437637 - DNA, 692 bp, Homo sapiens
  misc_feature: GZ8MTXP02JJ33O.13.38.D05.1.454.CMB.2.raw
  modified_base (185)..(185): a, c, t, g, unknown or other
  modified_base (237)..(237): a, c, t, g, unknown or other
  modified_base (376)..(376): a, c, t, g, unknown or other
tcagtcacgtactacacgaccggtgctcgatttagtatctgatagttgggtttgggggagtcagtctcagtcaggacacagcatggacatggacgggtccccgctcagctccgtggggctcctgctactctggctccgaggtgccagatgtgacatccagatgagccagtctccatcccaccctntctgcgtctcgtcggagacgagggtccaacctatccacgttggtaccggganaaggtcaagaacagttacggactaaacttactttaaatggttatcagacaggtaacgtcgacgggaccacgacccccgaactccgtagacttcgtaacggtacactccgtactttggccacgtaggtcggtacaccgtntacccgtacgttcgaagttcgggacaggttagcgtacgtaggaaacctacgttacctttaccactacccgtatcggtaacggttccacggagtccctagtacgttactttacgcgttaacttcttattacgtaccaagtaccgttaaccgtttacccgtacccgttacccccgggtaccgttaccgggacccgtaacggggacctaaacggggtacgtaaacgtacggaaacggtaccggtaacgtcggggtacgtaccgtcctaaccgaacctcgttaacgtcggttacttaccaccgtttccccctcgttaccc

SEQ ID NO: 437638 - DNA, 803 bp, Homo sapiens
  misc_feature: GZ8MTXP02HFF1M.13.38.D05.1.454.CMB.2.raw
  modified_base (267)..(267): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctcgtcggacgacgacgggtcaccatcacgttggcggtacaagtacagaactattggactaacttactttaaatggtancgtagcaagaagtacgagggaccaacgacccccgtaactcctagtactccgtaacgactacttacctactttcgacctacacgggtaggtacctacccgtaagttaccccgtaaaacggtttcgtacggtacgggacgtaacggttaacgacgttccgtaaaggtaaaccgtaacggttaacccctttttaaccccacgtaaacccgtagtcccggttaaggggttacctaccggtaacgtaccgttaggtaaacgtttacgtttacggaacctttaaccgttaaccgttaaacgtttcttaaaccgtaaacttaaaccgggttacccttttaaaccccggtttccccccggttacccccgggtaaccggtttacccggacccgggtaaaaccgggtaaacgtaaacccggggtaaaggaaaacgttaccggaaaacggttacccggaaacggttggtaaaccggtccggttaccacggtaaccctaacgttcggttacttccttaaccgttccttcccggttaaccccgttcccg

SEQ ID NO: 437639 - DNA, 844 bp, Homo sapiens
  misc_feature: GZ8MTXP02F4EE0.13.38.D05.1.454.CMB.2.raw
tcagtcacgtactacacgaccggtgctcgatttagtatctgatagttggggtttgggggagtcagtctcagtcaggacacagcatggacatgagggtcccccgctcagctcctggggctcctgctactctggctccgaggtgccagatgtgacatccagatgagccagtctccatcccaccctgtctgcgtctcgtcggagacagggtccaccatctagttggtcggactaagtcagaactagttcggactaaactttacgttttaaagttcggtaatcgaagtacgaaggaaggttaccggaaggggaccctaaacccggaccccccgtaaacccgttccgtaggtaactttaccggtaaaccggtaacctcgttacccctaaacctttggacccgtaaacgtaaggggttcggggaaaccttccccgtaaaagttaccccggtaaacgggtttccaagggtcgggttaacgaaaggtttaaggtacgttaccgttaaagggtaaaaccttaccgggtttaaaccctttttaaccccccaactaacccgttagttaccggtaaccggggttacctaacgaacggttaccgttaaggtaaagtttaccgttttaggaacccttaaactttacctttaaagtttaccgttaaaccgtaaacgttaacgggtttacccctttaaacccggtttccccgtaaacccccccggttgggttaacccggaacgggttaaccggaaccgtaaaggtaacggtaacttaaacggaacgtaacggtaaacgtggtacggtaccgacgtaccacgtaactttcgtaacttcgtacctactaccctttcgtaccc

SEQ ID NO: 437640 - DNA, 638 bp, Homo sapiens
  misc_feature: GZ8MTXP02GHLQJ.13.38.D05.1.454.CMB.2.raw
  modified_base (293)..(293): a, c, t, g, unknown or other
  modified_base (318)..(318): a, c, t, g, unknown or other
  modified_base (351)..(351): a, c, t, g, unknown or other
tcagtcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtcctccatccaccctgtctgcgtctcgtcggagacgaggtcaccatcacttggcggacaagtcaagaactattcggactaactactttaaagtggtatcagcagaagtcaggcaacgccccgactcngatctacgtacatccactttgctanaggtgactccatacgaagtcagtcgacagtagntcgtaggaaatacgttactttaacccacgtaacctagtaccgtaggggtactacgactaccgtagtaacgtatttcgacgttaccttattacgttacgtaactaacgtaagttaccgtttaacccgtttaccccgtacccccgggttaacgtttaccggaacccggaaacggggtaaccgaaacggggtttaaacggaaaacgttaacgaaacgtaccggtaagtacggttaggaccgttacgactacctaactgttacgttacttcgtaccttcctacccggttcc

SEQ ID NO: 437641 - DNA, 494 bp, Homo sapiens
  misc_feature: GZ8MTXP01EJES5.25.62.F07.1.454.CMB.2.raw
  modified_base (355)..(355): a, c, t, g, unknown or other
  modified_base (436)..(436): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctatgataatatatctggactctaagaggcctcagggatccctgacgcgattctctggctccngcgcagggacaactgtcacattgaccatcattggatcagcctgagacgaggctgggacttattactgtcagtcagtacgcnccaccactctcacgttcgcgttcggcgagggaccagctgacgtctggcagccgaagcc

SEQ ID NO: 437642 - DNA, 507 bp, Homo sapiens
  misc_feature: GZ8MTXP01A4BG1.25.62.F07.1.454.CMB.2.raw
  modified_base (272)..(272): a, c, t, g, unknown or other
  modified_base (306)..(306): a, c, t, g, unknown or other
  modified_base (356)..(356): a, c, t, g, unknown or other
  modified_base (401)..(401): a, c, t, g, unknown or other
  modified_base (471)..(471): a, c, t, g, unknown or other
  modified_base (506)..(506): a, c, t, g, unknown or other
tcagactgtacagtcacgaccggtgctcgatttagtagtcgcataaagggaaaggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggccctnattgataatatatctggactctaaagaggccctnagggatccctgagcgattctctggctcagccgcagggacaactgtacacnttgaccatcattggagtccagcctgaggacgaggctgactatacngtcagtcagtaggacgccaaccactactcacgtcgcgttcggcggaggaccaaggctgaccgtcttggcngcccaggctcgcccctggtcacttctcgttccccnc

SEQ ID NO: 437643 - DNA, 513 bp, Homo sapiens
  misc_feature: GZ8MTXP01CFQMU.25.62.F07.1.454.CMB.2.raw
  modified_base (358)..(358): a, c, t, g, unknown or other
  modified_base (361)..(361): a, c, t, g, unknown or other
  modified_base (377)..(377): a, c, t, g, unknown or other
  modified_base (386)..(386): a, c, t, g, unknown or other
  modified_base (396)..(396): a, c, t, g, unknown or other
  modified_base (399)..(399): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctattgataatatatctggactctaaagaggcctcagggatccctgagcgattctctggctccngcncagggacaactgtcanattgacatnatgagtcacncgngagacgagctagtactattactgtcagtcgagtacgacgaccaccactactctacgcgtcgttcggcggacggacgacgacgtcgtccgtccgtcgtcgacgaaccgaacgtcg

SEQ ID NO: 437644 - DNA, 542 bp, Homo sapiens
  misc_feature: GZ8MTXP01A5ZM0.25.62.F07.1.454.CMB.2.raw
  modified_base (272)..(272): a, c, t, g, unknown or other
  modified_base (363)..(363): a, c, t, g, unknown or other
  modified_base (492)..(492): a, c, t, g, unknown or other
  modified_base (521)..(521): a, c, t, g, unknown or other
tcagactgtacagtcacgaccggtgctcgatttagtagtcgcataaagggaaaggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggccctnatgataatatatctggactctaaagaggccctcgagggactccctgacgcgattctctggctccgagccgcgagggacaactcgtacactnttcgaccatcagttggacgtccagcctggaggacgaggctagactatactgtcagtcagtacggacgccacactactccacgtcgtacggtcggcggacggaccaagcgtcgaccgttccttcggtacncggcccgaggcctcgcccccgtggtaccncttcctccgttccccgtcccc

SEQ ID NO: 437645 - DNA, 520 bp, Homo sapiens
  misc_feature: GZ8MTXP01EAK8T.25.62.F07.1.454.CMB.2.raw
  modified_base (363)..(363): a, c, t, g, unknown or other
  modified_base (481)..(481): a, c, t, g, unknown or other
tcagactgtacagtcacgaccggtgctcgatttagtagtcgcataaagggaaagggggggtccgaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctcattgataatatatctggactctaaagaggcccctcgagggatccctgagcgattctctggctccagccgcagggacaactgtacacnttgaccatcattggatccagcctgaggacgaggctagactattactgtacagtacagtaggacgccaaccactactcacgtcgacgttcggcggagggaccaagctgacgtccttgcngcccaggctcgcccctggtcacttctccgttcccgtccc

SEQ ID NO: 437646 - DNA, 504 bp, Homo sapiens
  misc_feature: GZ8MTXP01BDG7L.25.62.F07.1.454.CMB.2.raw
  modified_base (263)..(263): a, c, t, g, unknown or other
  modified_base (293)..(293): a, c, t, g, unknown or other
  modified_base (327)..(327): a, c, t, g, unknown or other
  modified_base (357)..(357): a, c, t, g, unknown or other
  modified_base (424)..(424): a, c, t, g, unknown or other
  modified_base (443)..(443): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttacnggtaccagcagaaggcgggccaggcccctntattgataatatatctggactctaagaggccctnagggatccctgacgcgattctctggctccngcgcagggacaactgtcacattgaccatcattggatccagcctgagacgaggctgggacttattacngtcagtcagtagcgccacnctactcacgttcgcgttcggcggagggaccagctgaccgtcttgggcacgcccaagggccc

SEQ ID NO: 437647 - DNA, 506 bp, Homo sapiens
  misc_feature: GZ8MTXP01A8PRF.25.62.F07.1.454.CMB.2.raw
  modified_base (292)..(292): a, c, t, g, unknown or other
  modified_base (325)..(325): a, c, t, g, unknown or other
  modified_base (347)..(347): a, c, t, g, unknown or other
  modified_base (357)..(357): a, c, t, g, unknown or other
  modified_base (422)..(422): a, c, t, g, unknown or other
  modified_base (426)..(426): a, c, t, g, unknown or other
  modified_base (449)..(449): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagaggccctnagggatccctgacgcgatttcnctggcctccngcgcagggacaactgtcacattgaccatcattggagtccagcctgagacgagctggactattacngtcngtcagtagacgccaccactaacncacgttcgcgttcggcggaggaccagctgacccgtcttcggcacgtcccgaaggtcc

SEQ ID NO: 437648 - DNA, 510 bp, Homo sapiens
  misc_feature: GZ8MTXP01EMPAC.25.62.F07.1.454.CMB.2.raw
  modified_base (360)..(360): a, c, t, g, unknown or other
  modified_base (432)..(432): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctatgataatatatctggactctaagaggccctgagggatccctgacgcgattctctggcctccngcgcagggacaactgcacattgaccatcattggaagttccagcctgaggacgagggctggactattactgtnagtcagtagacgccacactctcacgttcgcgttcggcggaggaccgagctgaccgtcgttggcacgcccgaagtcccg

SEQ ID NO: 437649 - DNA, 600 bp, Homo sapiens
  misc_feature: GZ8MTXP01CLLOA.25.62.F07.1.454.CMB.2.raw
  modified_base (234)..(234): a, c, t, g, unknown or other
  modified_base (255)..(255): a, c, t, g, unknown or other
  modified_base (288)..(288): a, c, t, g, unknown or other
  modified_base (352)..(352): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctggtgtcagtgtccccaggacagacggcaggatcacctgctntggagatgctttgaccaacanaatatgtactggacagcagagcggcagcccctntatgataatatatctggactcgtaagacgcctcgaggactccctgacgcgattctctggctacncgcgacgacgggaacgaaccgttaacgtacactactacgtactaactacgtagttacggtacgtacgacgacgacggacggacggacggtacgtacggtaacgtattacgtacgtacgtacgtacgtacgtaacgaccgtacccaacctaacctacgtaaccgtacggttccggtccggttacgggtacgggaacgggaacggacgacgtaacgtaccgtccgtcggtacgacgtaaccgaacgtccg

SEQ ID NO: 437650 - DNA, 530 bp, Homo sapiens
  misc_feature: GZ8MTXP01ALYUE.25.62.F07.1.454.CMB.2.raw
  modified_base (363)..(363): a, c, t, g, unknown or other
  modified_base (513)..(513): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctctattgataatatatctggactctaagacggccctcgagggactccctgacgcgattctctggcctcngcgcgagggacaactgtcactattgaccatcattggatccagcctgagacgagctggtactattactgtacagtcaaggtacgaccgtaccacctactcctcacggttcgcgttccggaggacggaccgagctcggaccttcgtggtccngtccccgaaggtccccg

SEQ ID NO: 437651 - DNA, 593 bp, Homo sapiens
  misc_feature: GZ8MTXP01CLT4B.25.62.F07.1.454.CMB.2.raw
  modified_base (295)..(295): a, c, t, g, unknown or other
  modified_base (367)..(367): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgtctttgaccaacacaatatggttactggtaccagcagaaggcggcagcccctntatgataatatatctggactacgtaagacggccctcgagggactcccgtgacgcgtattctctggcctccgngcgcgagggacaactgtacactattgacctatacattgggacgttaccagccctaggacggacggaaggtcctagggtaacttagtttacctggtaccaagttccaagtacgccgacccaacctactactccgtaacgttcggtccggttccgggacgggaacgggaccccgaagccctaacggtacccggttccgttcgggaccacggtccccgaagggtccccg

SEQ ID NO: 437652 - DNA, 575 bp, Homo sapiens
  misc_feature: GZ8MTXP01EN8UQ.25.62.F07.1.454.CMB.2.raw
  modified_base (259)..(259): a, c, t, g, unknown or other
  modified_base (300)..(300): a, c, t, g, unknown or other
  modified_base (475)..(475): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgctttgaccaaacanaatatggttactggtaccagcagaaggcggccaggcccctntattgaataatatatctaggactactaagacggccctgagggactcccgtgacgcgtattcgtctcggctccgaagccgacgaacgggaactaaacgtcgtacctaactagttacacctatctaagttggaacgtccaagccaggagacgagcttagggactttattacctgtanagtacagtacgacctaccaccacgtactcgacgttcgccggttcggacggacggacgacgctcggacccgttcgttgggccacgtcccgaacggtccccg

SEQ ID NO: 437653 - DNA, 525 bp, Homo sapiens
  misc_feature: GZ8MTXP01A9JFZ.25.62.F07.1.454.CMB.2.raw
  modified_base (317)..(317): a, c, t, g, unknown or other
  modified_base (361)..(361): a, c, t, g, unknown or other
  modified_base (466)..(466): a, c, t, g, unknown or other
  modified_base (471)..(471): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctattgataatatatctgactntaagaggccctgagggctccctgacgcgatttctctggcctccngccgcgaaggggaccaacgtgtcaactattgaccctaatcagtttggactccagccctgaggacgagctagggactattactgtcagtcagtacgacgccaaccnctacncacgttcgcgttcgggcgagggaccagctcgacgtcttggcacgccaaggtccc

SEQ ID NO: 437654 - DNA, 513 bp, Homo sapiens
  misc_feature: GZ8MTXP01EVA2F.25.62.F07.1.454.CMB.2.raw
  modified_base (438)..(438): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggcctcaggatccctgacgcgattctctggctccaagcgcagggacaactgtcacattgaccatcattggaagtccagcctgagacgagggctgggactattactgtcagtcagtacncgccacactactcaacgttcgcggttcggcggagggacccagcgtgaccgtccgttgggcacgtcccgaaggtcc

SEQ ID NO: 437655 - DNA, 570 bp, Homo sapiens
  misc_feature: GZ8MTXP01DOO75.25.62.F07.1.454.CMB.2.raw
  modified_base (295)..(295): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctgagggatccctgacgcgtattctctggcctcccaaggccgacgaaggggacaaaccgtggtacaactatttgaacccatcaatttggaacgttcccaagcccaggaaccgggaacgaagggcctaggggtaaccttaagtttaacctggttaccaggttcaagtagacgtccaaccactacgtcacgttcgcgttcggacggaggacccgagctcgaccgtcttgcacgcccgaaggtcccg

SEQ ID NO: 437656 - DNA, 547 bp, Homo sapiens
  misc_feature: GZ8MTXP01EYAT1.25.62.F07.1.454.CMB.2.raw
  modified_base (297)..(297): a, c, t, g, unknown or other
  modified_base (372)..(372): a, c, t, g, unknown or other
  modified_base (477)..(477): a, c, t, g, unknown or other
  modified_base (487)..(487): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgtctttgaccaaacacaatatggttactggtaccagcagaggcggccaggcccctntattgataatatatctaggactacgtaagacggtcctagagggactcccgtgaccgcgtattctctcggcctcgngcgacgagggactaacgtgtacactattcgacctatctagttggaactccagcctaggacggacgagggctggaactttagttactgtaccagtcagtacgaccnccaccactcncacgttcgcgttcggcggaggaccagctaacgccgttcgttgcacgtcccgaaggtcccg

SEQ ID NO: 437657 - DNA, 564 bp, Homo sapiens
  misc_feature: GZ8MTXP01B5QM9.25.62.F07.1.454.CMB.2.raw
  modified_base (299)..(299): a, c, t, g, unknown or other
  modified_base (309)..(309): a, c, t, g, unknown or other
  modified_base (318)..(318): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtccagtcgtccccaggacagacggccaggatcacctgctctggagatgtctttgaccaacacaatatggttactggtaccagcagaggcggcacgcccctntatgatatanatctgactntaagacgcctgaggactcccgtgacgcgtattctcgtggacctcaagcgacgacgggaccaagtcgtacactattgaacctatacctaagttgggaccgttaccagtccgtaggacgacggaggtcctagggtaacttagttaccttgacctagtcaagttacgacctacccacaaccgtactcgacgttcgccgttggacgggacggcacgcgtaagcccgtcgttcgacaccgccgaagtcccg

SEQ ID NO: 437658 - DNA, 521 bp, Homo sapiens
  misc_feature: GZ8MTXP01CS0L2.25.62.F07.1.454.CMB.2.raw
  modified_base (294)..(294): a, c, t, g, unknown or other
  modified_base (328)..(328): a, c, t, g, unknown or other
  modified_base (358)..(358): a, c, t, g, unknown or other
  modified_base (426)..(426): a, c, t, g, unknown or other
  modified_base (475)..(475): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctnagggatccctgacgcgattctctggctccngcgcgaagggacaactgtcacattgaccatcattggagtccagcctgagacgaggctggactattacngtcagtcagtacgcgtccacactctcaacggttcgtcgttcgggacggngggaccaaggctaagacccgttcgttgggcacgcccgaaggtcccg

SEQ ID NO: 437659 - DNA, 517 bp, Homo sapiens
  misc_feature: GZ8MTXP01CJIJ0.25.62.F07.1.454.CMB.2.raw
  modified_base (328)..(328): a, c, t, g, unknown or other
  modified_base (446)..(446): a, c, t, g, unknown or other
  modified_base (481)..(481): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctnagggatccctgacgcgattctctggctcccgaagcgcaaggggacaacgtgtacacattcgaccatcattggagtccagcctgagacgaggctgggacttattactgtcagtcagtanacgccaccactactcacgttcgccgttcggacggnggaccagctgacccgtcttggcagtcccgaaggccc

SEQ ID NO: 437660 - DNA, 562 bp, Homo sapiens
  misc_feature: GZ8MTXP01CW6YD.25.62.F07.1.454.CMB.2.raw
  modified_base (300)..(300): a, c, t, g, unknown or other
  modified_base (391)..(391): a, c, t, g, unknown or other
  modified_base (450)..(450): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccacactcggtgtcagtgtccccaggacagacggccaggatcacctgctctggagatgctttgaccaaacacaatagtggttactggaccagacagaaggcggccacggcccctntatgataatatatctaggactcgtaagacgccctagagggactcccgtgacgcgtattctcgtgggcctccagccgacgagggacaacgtntcactattcgaccatcagttcggactccagcctagaggacgaggctagtactattacgngtcagtcgagtacgaccacctaacctactaactcgaccggtcgttcggtaccgggacggaacggaccgacgtcgtaccgtaacccgttcgtacgaccgtaacgaaccgaacg

SEQ ID NO: 437661 - DNA, 514 bp, Homo sapiens
  misc_feature: GZ8MTXP01BAOZT.25.62.F07.1.454.CMB.2.raw
  modified_base (293)..(293): a, c, t, g, unknown or other
  modified_base (356)..(356): a, c, t, g, unknown or other
  modified_base (446)..(446): a, c, t, g, unknown or other
  modified_base (451)..(451): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagagggcggccaggcccctntatgataatatatctggactctaagaggccctgagggactccctgacgcgattctctggctcngcgacagggacaactgtacacattgaccatcattggacgtccagcctgaggacgaggctggactattactgtcagtcagtagacgccacnctacncacgttcgcgttcggacggacgggaccagccgtgacccgtccgttgggcacgcccaagggccc

SEQ ID NO: 437662 - DNA, 502 bp, Homo sapiens
  misc_feature: GZ8MTXP01DLTL3.25.62.F07.1.454.CMB.2.raw
  modified_base (359)..(359): a, c, t, g, unknown or other
  modified_base (402)..(402): a, c, t, g, unknown or other
  modified_base (434)..(434): a, c, t, g, unknown or other
  modified_base (467)..(467): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccacggcccctctattgataatatatctggactctaagaggcctcagggatccctgacgcgattctctggctcngcgcagggacaactgtcacattgaccatcattggagtcagccngagcgagctggactattactgtcagtcagtanacgccaccactactcacgttcgcgttcggcggnggaccagctgaccgtcttggcacgcccgaagtccg

SEQ ID NO: 437663 - DNA, 623 bp, Homo sapiens
  misc_feature: GZ8MTXP01DR750.25.62.F07.1.454.CMB.2.raw
  modified_base (298)..(298): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgtctttgaccaacacaatatggttactggtaccagcagaaggcggccaggcccctntatgataatatatctgactctaagacgcctagaggactccctgacgcgattctctggctcaagcgacgacgggacaactgtacactatttcgaacctatacctagtttacggggaacgttccccgaagtccccggtaggaacgggaaccggtaggggtacctaggggtaacctttaagtttaaccgtggttaccagttacaggttaacgaccgtacccacctaccttactaacgaccggttcggtccggttcgggacgggaaggaccccgaagccgtaacggtacccgttccgtttcggaccgacggtaacccgaagggtccccg

SEQ ID NO: 437664 - DNA, 633 bp, Homo sapiens
  misc_feature: GZ8MTXP01CPV0F.25.62.F07.1.454.CMB.2.raw
  modified_base (300)..(300): a, c, t, g, unknown or other
  modified_base (322)..(322): a, c, t, g, unknown or other
  modified_base (371)..(371): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgaccaacacaatatggttactggtaccagcaggaacggcggccacggcccctntattgataatatatctagactntaagcgcctcgaggtactcccgtagacgcgtattctcgtcggacctccngcgacgacgggaactaacgtcgtacaactagttcgaacctatcgtagttgggaacttccgaacgtcccgtaggacgggaacggtacgggtccttagggtaacttttaagtttaccgtcgtacgtacggttaccgaaggttaaccgaccgtacccctaaaccttaaccgtactaaccgacggttccggtcggttacggggacgggtacggaaccgttagcgttcggacccgtttcgtacggacgacgaacccgaaggtccccg

SEQ ID NO: 437665 - DNA, 528 bp, Homo sapiens
  misc_feature: GZ8MTXP01A5OZ8.25.62.F07.1.454.CMB.2.raw
  modified_base (363)..(363): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtacagcagaaggcggccaggcccctctattgataatatatctggactactaagacggccctcgagggactcccgtgacgcgtattctctggctccngcgcgagggacaactcgtacactattgaccatcattggagtcagcctagagacgaggctggatttattacgtgtcagtcaggtacgcgtacccaccactactcacggttcgacggttcggcgggaggaccgagctcggaccgtcgttggcacgccgaagggtccc

SEQ ID NO: 437666 - DNA, 516 bp, Homo sapiens
  misc_feature: GZ8MTXP01DTRJI.25.62.F07.1.454.CMB.2.raw
  modified_base (272)..(272): a, c, t, g, unknown or other
  modified_base (286)..(286): a, c, t, g, unknown or other
  modified_base (305)..(305): a, c, t, g, unknown or other
  modified_base (364)..(364): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtcccaggacagacgccaggatcacctgctctggagatgctttgccaaacacaatatggttactggtacagcagaggcggcaggcccctnatgataatatatcnggactctaagacggccctnaggactcccgtgagcgattctctggctccagccgcgagggacaactgtaacacaagttnaccatcagttgggactcagcctaggacgagaggctagactatactgcagtcagtagacgccacactacctcacgtcgcgtcggcggaggctcgaagcttggaccgttcgtgggtcacgccaaggcctcgcccgtcgcactcgttcgttcccc

SEQ ID NO: 437667 - DNA, 587 bp, Homo sapiens
  misc_feature: GZ8MTXP01B6MUW.25.62.F07.1.454.CMB.2.raw
  modified_base (295)..(295): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaaggacgccctagaggtactcccgtgacgcgtacttctcgtcggcctccgaacgcgacgaacggggaccaacgttcgtacaactatttcgaaccctatacgtagttgggaacgttccgaacgcccgtaggaacgggtacgaagggtctaggggtaacctttatttaactcgtcaagttcgagtaccgacgtcccacctacctactcgacgttccgtcggttcggcggacggacgacgcgtcgtaccgtcttcgggcacgccgaaggtccc

SEQ ID NO: 437668 - DNA, 523 bp, Homo sapiens
  misc_feature: GZ8MTXP01BN26E.25.62.F07.1.454.CMB.2.raw
  modified_base (292)..(292): a, c, t, g, unknown or other
  modified_base (356)..(356): a, c, t, g, unknown or other
  modified_base (455)..(455): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntatgataatatatctgactctaagagccctgagggactcccgtgacgcgtattctctggcctcngcgcgagggacaactgtacacattgaccatcattggatccagtccagagacaggctagggacttagttactgtcagtcagtaacgcgaccaccactacncacgttcgcgttcgggacggagggacccaagcctaaggtaccgtccttggcaacgcccgaagggtccc

SEQ ID NO: 437669 - DNA, 540 bp, Homo sapiens
  misc_feature: GZ8MTXP01DN3BY.25.62.F07.1.454.CMB.2.raw
  modified_base (273)..(273): a, c, t, g, unknown or other
  modified_base (299)..(299): a, c, t, g, unknown or other
  modified_base (359)..(359): a, c, t, g, unknown or other
tcagactgtacagtcacgaccggtgctcgatttagtagtcgcataaagggaaaggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaaacacaatatggttactggtaccagcagaggcggcaggcccctnatgataatatatctggactctaaagnggcccctgagggatccctgagcgtattctctggctccagccgcagggacaactgtacacnttgaccatcattggatccagctgaggacgaggctagtactagttactgtacagtcagtacggacgccaccactactcacgtcgacgttcggcggtagggatcgaaagtcttggaccgttcgttggtcacggcccaacggcctcgcccccgttcggtccttaccgttccgttcggttccccg

SEQ ID NO: 437670 - DNA, 587 bp, Homo sapiens
  misc_feature: GZ8MTXP01EAN7F.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcggccacggcccctctatgataatatatctggactctaagaggccctgagggatccctgacgcgattctctggcctcaagcgcgagggacaacgtgtcactattcgacctatcagttacggaacgttccgagcccgtaggacgggaacgaagggtctaggggtaaccttatttaacgtcgtacacgtcaggttaacgaccgtcccaacctactctcgaacgttccgacggttcgggacgggtaacgggaccgacgttaccgtcggacccgttccgtcgggtaccaccgaacccgaacggtccccg

SEQ ID NO: 437671 - DNA, 679 bp, Homo sapiens
  misc_feature: GZ8MTXP01C2FAY.25.62.F07.1.454.CMB.2.raw
  modified_base (239)..(239): a, c, t, g, unknown or other
  modified_base (250)..(250): a, c, t, g, unknown or other
tcagactgtacagtcacgaccggtgctcgatttagtagtcgcataaagggaaagggggggtccaggaggcagaactctcgggacgtctccaccatggcctgggctctgctgttcctcaccctcctcactcagggcacagggtcctgggcccagtctgccctgactcagcctgcctccgtgtctgggactctggacagtcgtcaccatctcctgcactggaaccagccgtgacattggtnacttataactntgtcctcctggtcccaacaacacccaggcaacggccccaaactcatcatttatgatgtcagtcatcggcctcgtggtagtttcgttgtcgtcttctctcggctcagtctggacaactcggcctccctgacctactcgtcgggctccgaggctaggacgacgaggcttacgtttattattgactatttacattacgaagtaacgaacaacctaaacgacgttccgttaggggttacggtttcgggaccggggaacggggtaacccgtaaaggtttcgggtaaaccccggtttcccggttaccggggttaccgtaaaccgggtccccgaaacggggttcccttacccgggtcccccccgtttaccgggggttccctaaccccgggttttcccttccggttttaaccccccccgaacccccgttttcccccg

SEQ ID NO: 437672 - DNA, 505 bp, Homo sapiens
  misc_feature: GZ8MTXP01E37ZU.25.62.F07.1.454.CMB.2.raw
  modified_base (328)..(328): a, c, t, g, unknown or other
  modified_base (448)..(448): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctnagggatccctgacgcgattctctggctccaagcgcagggacaactgtcacattgaccatcattggagtcagcctgagacgaggctggactatactgtcagtcagtagacgccaccactcncacgttcgcgttcggcggacgggacaagctgaccgtcgttaggcagcccgaaggccc

SEQ ID NO: 437673 - DNA, 761 bp, Homo sapiens
  misc_feature: GZ8MTXP01DTD5H.25.62.F07.1.454.CMB.2.raw
  modified_base (238)..(238): a, c, t, g, unknown or other
  modified_base (293)..(293): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacgccaggatcacctgctctgganatgctttgccaacacaatatggttactggtacagcagaaggcgggcaggcccctntattgataatatatctaggactctaagacggccctgagggactccctcgtagccggtatttccgtctcgggtacccttcccgaaggccggacgaacgggggaaaccaaaccgttcgggtacctaaaccgtaacttttacggaaacccctaagttaccctaagttttacggggaaacgttcccgaaacgggtccccttaggggaaacgggacccggaaagggtccttagggggtaaacctttaagtttaacccgttgggttacctaacgggttacccaaggttaacgacccggtcccaaaccctaccttaaccctaacccgtaaccgggttcccggtacccggtttacccgggggaccgggtaaccggggttaaaccccgttaaacggacccggttccggtaaacccccggtttccccgtttagggtcccgttaacccgggtaacccccggaaagggggtttccccccg

SEQ ID NO: 437674 - DNA, 549 bp, Homo sapiens
  misc_feature: GZ8MTXP01DG89Y.25.62.F07.1.454.CMB.2.raw
  modified_base (295)..(295): a, c, t, g, unknown or other
  modified_base (359)..(359): a, c, t, g, unknown or other
  modified_base (446)..(446): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgtctttgccaacacaatatggttactggtaccagcagaaggcggcaggcccctntatgataatatatctggactctaagacgccctgaggactccctgacgcgtattctctggcctcngcgcgaagggacaacgtgtacactattgaccatcattggacgtccagccgtgaggacgaggcctagggtaacttattaactggtacngtcaggttaacggccgaccaccactactccacgttcgtcggttcgggacggacgggaccgaagccgtaacgtacccgtcgttggccacgcccgaaggtccccg

SEQ ID NO: 437675 - DNA, 516 bp, Homo sapiens
  misc_feature: GZ8MTXP01CIDQT.25.62.F07.1.454.CMB.2.raw
  modified_base (356)..(356): a, c, t, g, unknown or other
  modified_base (359)..(359): a, c, t, g, unknown or other
  modified_base (371)..(371): a, c, t, g, unknown or other
  modified_base (442)..(442): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctatgataatatatctggactctaagaggccctcagggatccctgacgcgattctctggcctcngcncgagggacaacngtcactattgaccatcattggagtccagcctagagacgaggctaggacttattactgacagtcagtagacnccaccactactcacgttcgcgttcgggacggagggaccgagcgtgaccgtcccgttggcacgcccgaaggtccc

SEQ ID NO: 437676 - DNA, 517 bp, Homo sapiens
  misc_feature: GZ8MTXP01EAE9N.25.62.F07.1.454.CMB.2.raw
  modified_base (296)..(296): a, c, t, g, unknown or other
  modified_base (318)..(318): a, c, t, g, unknown or other
  modified_base (330)..(330): a, c, t, g, unknown or other
  modified_base (458)..(458): a, c, t, g, unknown or other
  modified_base (485)..(485): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctntattgataatatatctggactntaagaggccctnagggatccctgacgcgattctctggcctcaagcgcagggacaactgtcacattgaccatcattggagtccagcctgaggacgaggctagggacttattactgtcagtcagtaacgcgccacactaccnctcgttcgtcgttcggcggacggacgngcgtcgtccgtcgtcgcacgtccgaacgtccg

SEQ ID NO: 437677 - DNA, 713 bp, Homo sapiens
  misc_feature: GZ8MTXP01DLB4M.25.62.F07.1.454.CMB.2.raw
  modified_base (296)..(296): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactactaagacggccctcgagggtactcccgtgacgcgtattcgtctcggctccaagcgacgacggggacaacgtgtacactattacgaaccctataccaagtttaggaacgttccccgaaggccccgttagggaacgggaaccggagggtaccttagggggtaacctttaagtttaaccgtgggttaacaacggtttacccgaaaggttaaaccgggaacccgtccccgaaaccccgtaaccgtaaccctttcccggaaacccggttcccgggtacccggggtttaccgggggaccgggggtaacggggttaaacccccgaaaggttccccgttaacggtaacccccggtttccgtttcgggaccgttaaccggtaacccccgggaaaggtccccccgg

SEQ ID NO: 437678 - DNA, 512 bp, Homo sapiens
  misc_feature: GZ8MTXP01D9MGY.25.62.F07.1.454.CMB.2.raw
  modified_base (292)..(292): a, c, t, g, unknown or other
  modified_base (328)..(328): a, c, t, g, unknown or other
  modified_base (437)..(437): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacgccagatcacctgctctggagatgctttgccaacacaatatggttactggtaccagcagaaggcggccaggcccctntatgataatatatctaggactctaagaggcccttanagggatccctgacgcgtattctctggacctcaagcgcaaggggacaacgtgtacactattgaccatcaattggatccagcctgagacgaggctaggacttattactgtnagtcagtaagctccaactcactcacgttcgcgttcggcggaggaccagctgaccgtcttggcagccgaaggtccc

SEQ ID NO: 437679 - DNA, 512 bp, Homo sapiens
  misc_feature: GZ8MTXP01BKLMZ.25.62.F07.1.454.CMB.2.raw
  modified_base (272)..(272): a, c, t, g, unknown or other
  modified_base (293)..(293): a, c, t, g, unknown or other
  modified_base (305)..(305): a, c, t, g, unknown or other
  modified_base (356)..(356): a, c, t, g, unknown or other
  modified_base (420)..(420): a, c, t, g, unknown or other
  modified_base (497)..(497): a, c, t, g, unknown or other
tcagactgtacagtcacgaccggtgctcgatttagtagtcgcataaagggaaaggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggccctnattgataatatatctggactntaagaggccctnagggatccctgagcgattctctggctccagccgcagggacaactgtacacnttgaccatcattgggatccagcctggaggacgaggctagacttatactgcagtcagtagggacncaccactatcgacgtcgcgttcggcggaggccaagtcgtgaccgtcttggtcaggccccgagctcgcccctggtccncttctccgttcccgc

SEQ ID NO: 437680 - DNA, 622 bp, Homo sapiens
  misc_feature: GZ8MTXP01CELR5.25.62.F07.1.454.CMB.2.raw
  modified_base (220)..(220): a, c, t, g, unknown or other
  modified_base (276)..(276): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgccaaacacaatatggttactggtaccagcagaaggcggcaggcccctnatgataatatatctggactctaaagcggccctgacgggactcccgtgacgcgtattctcgtggcctccgagcccgcgaggggacaacgtcgtacaactgttacgaaccctatcagtttcgggacgtcccagcccgtaggacggacgaggtctaggaacttattacgtgtacctagtacgaaggtacggaccgaccctaacccactacctccgacggtcgtaccgggttcggacgggacggaccaaggcctacggacccgttcgttcggtaccacggttacccgacgggttccctcccggcccccttaacgggtccctaccgttccgttcccgttccccgtaacccc

SEQ ID NO: 437681 - DNA, 567 bp, Homo sapiens
  misc_feature: GZ8MTXP01A6WTO.25.62.F07.1.454.CMB.2.raw
  modified_base (240)..(240): a, c, t, g, unknown or other
  modified_base (299)..(299): a, c, t, g, unknown or other
  modified_base (373)..(373): a, c, t, g, unknown or other
  modified_base (428)..(428): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgtctttgaccaacacaatatggttactggtaccagcagaaggcggccacggcccctntatgataatatatcgtggtactacgtaagacggccctacgagggtactcccgtgacgcgtattctctggcctcngcgcgacgggacaacgtgtacactattgacctatcaagttcggagtccagtccgnggacggacgaggtcctagggtaactagttacgtgtacctagtaccagtacgacctacccacctactacctcgaccgttcggtacgttcgggacggacgggacagctcgaccgttcgtcggtccacgtccgaacgtcccg

SEQ ID NO: 437682 - DNA, 530 bp, Homo sapiens
  misc_feature: GZ8MTXP01EJAPK.25.62.F07.1.454.CMB.2.raw
  modified_base (291)..(291): a, c, t, g, unknown or other
  modified_base (359)..(359): a, c, t, g, unknown or other
  modified_base (478)..(478): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacgccagatcacctgctctggagatgctttgccaacacaatatggtactgtaccagcagaaggcggcacggcccctntatgataatatatctggactctaagacggcctcgaggctcccgtgacgcgtatctctcggcctaccgngcgacgagggacaactgcacattcacctatctagttggaacgtccgaagccgtaggacgggacgaagggctacgggtacttatttaccgtgtaccagtcagtacgccacctaccactcncacgttcggcgttggcggaggacagctaagccgtcgtgcacgccgaagtccg

SEQ ID NO: 437683 - DNA, 507 bp, Homo sapiens
  misc_feature: GZ8MTXP01BKI66.25.62.F07.1.454.CMB.2.raw
  modified_base (329)..(329): a, c, t, g, unknown or other
  modified_base (359)..(359): a, c, t, g, unknown or other
  modified_base (451)..(451): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcgggccaggcccctctatgataatatatctggactctaagaggccctnagggatccctgacgcgattctctggctccngcgcgaggggacaactgtcacattgaccatcattggagtcagcctgagacgagctggactattactgtcagcagtacgcgcccaccactacncacgttcgcgttcgcgggagggaccagctgaccgtcttggcacgcccgaaggtccc

SEQ ID NO: 437684 - DNA, 537 bp, Homo sapiens
  misc_feature: GZ8MTXP01ELLCU.25.62.F07.1.454.CMB.2.raw
  modified_base (240)..(240): a, c, t, g, unknown or other
  modified_base (329)..(329): a, c, t, g, unknown or other
  modified_base (406)..(406): a, c, t, g, unknown or other
  modified_base (439)..(439): a, c, t, g, unknown or other
  modified_base (451)..(451): a, c, t, g, unknown or other
  modified_base (465)..(465): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgaccaacacaatatggttactggtaccagcagaaggcggccaggcccctctatgataatatatctggactctaagagccctnagggatcccgtgacgcgattctctggcctccaagcgacgagggacaactgcactatcgaccatcagttggactcganccgtagagacgaggctaggacttattactgtcngtcagtacgacncccaaccacttacncacgttcgtccggttcggcgggaacgggaccacggctcgaccgttccgttgggacacgtcccgaaggtcccc

SEQ ID NO: 437685 - DNA, 509 bp, Homo sapiens
  misc_feature: GZ8MTXP01DPPHM.25.62.F07.1.454.CMB.2.raw
  modified_base (301)..(301): a, c, t, g, unknown or other
  modified_base (335)..(335): a, c, t, g, unknown or other
  modified_base (366)..(366): a, c, t, g, unknown or other
  modified_base (387)..(387): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtcccccctctacttcctccccctcctcactctctgcacagggtctgaggcctcctatgaggtgacacagcccaccctcggtgtcagtcgtccccaggacagacggccaggatcacctgctctggagatgcttgaccaacacaatatggttactggtaccagcagaaggcggccaggcccctntatgataatatatctggactactaagaggccctnagggatccctgacgcgtattctctggctccngcgcagggacaacgtgtcacnttgaccatcattggatcagcctgagcgagctggactattactgtcagtcagtagcgtccacactatcacgttcgtcgttcggcgaggaccgagcgtcgaccgtcttggcacgccaaggtccc

SEQ ID NO: 437686 - DNA, 667 bp, Homo sapiens
  misc_feature: GZ8MTXP01C32WB.25.62.F07.1.454.CMB.2.raw
  modified_base (300)..(300): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctctcactctctgcacagggtctgaggcctcctatgaggtgacacagccaccctggtgtcagtcgtccccaggacagacggcaggatcacctgctcgtggagtatgtcttgaccaaacacaatatggttactggtaccagcaggaaggcggccacggcccctntatgataatatatctaggactctaagcggcctagagggtactccctgacgcgtattctcgtcggcctccaagcgacgagggacaacgtgtacaactattcgaccatcgattagggacttccgaagccgtagaacgggacggacggccttaggggtaacttacgttaacgtcgtaccgtaaggtacccgtaaggttaaaccggacccgtcccctaaacctaacccgttaacccgtaaccggtaacccggttccgggttaccggttcccgggggaacggggaaccgggaacccgttaacggttcccgtaaccgggtaaccccgttccggtttcgggacccgaaccgggcccgttaaccggggttccccg

SEQ ID NO: 437687 - DNA, 646 bp, Homo sapiens
  misc_feature: GZ8MTXP01CK5DZ.25.62.F07.1.454.CMB.2.raw
  modified_base (321)..(321): a, c, t, g, unknown or other
  modified_base (386)..(386): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctggagatgctttgccaaacacaatatggttactggtaccagcagaaggcggccacggcccctctacttgtcttctacggtgaaaaccnccccgcccctcgagggatctcacgacgattctccgtcggctcccgccctacgaaacgggaaaccncgaagtccctttcccttcgaccctatccaacgttcgggggactccgaagggcgacgaaagagttaggacggtcgtagaacttacttaacgttcgtttcccggtacccggggtacaacccgtaggttacggtaaacgtcgtaagggtttgtcggttcggttcggcgggtaagggaaccaagggttcgtaccgttcgtaacggtcacggcccgaacggtctacccggccccgttcggccttaccgtccgttccgttcccccg

SEQ ID NO: 437688 - DNA, 516 bp, Homo sapiens
  misc_feature: GZ8MTXP01ELKIJ.25.62.F07.1.454.CMB.2.raw
  modified_base (273)..(273): a, c, t, g, unknown or other
  modified_base (306)..(306): a, c, t, g, unknown or other
  modified_base (360)..(360): a, c, t, g, unknown or other
  modified_base (405)..(405): a, c, t, g, unknown or other
tcagactgtacagtcacgaccggtgctcgatttagtagtcgcataaagggaaaggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaaacacaatatggttactggtaccagcagaggcggcaggcccctnattgataatatatctggactctaagaggccctnagggatccccgtgagcgattctctggctccagcccgcagggacaactgtacacnttgaccatcattggagtccagcctgaggacgaggctgactatacngtcagtcagtaggacgtcaccactactcacgtcgcgttcggcggaggaccaagctcgaccgtcttggcacgcccgaggctcgcccctcggtcacttctcgttccctaaccc

SEQ ID NO: 437689 - DNA, 622 bp, Homo sapiens
  misc_feature: GZ8MTXP01BRGOC.25.62.F07.1.454.CMB.2.raw
  modified_base (301)..(301): a, c, t, g, unknown or other
  modified_base (372)..(372): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctcgtggagatgtcttgaccaacacaatatggttactggtacagcagaaggcggccacggcccctntatgataatatatctagactactaagacgccctcgagggactcccgtgacgcgtattctcgtcggcctccnggccgacgacgggactaacgtgtacactattcgacctatcagttggacgtcagtccaggacgacggacgctagggtacttaacttacgtgtacgaacggttccgaaggttaaccggaccgaccccaaccctacctccctaaccgtaccggttccggtcccgggttcgggaaccggggtaacgggaacccgaacggttccgtccggtacccggttccgttcggggtaccacggtccccgaagggttccccg

SEQ ID NO: 437690 - DNA, 690 bp, Homo sapiens
  misc_feature: GZ8MTXP01BJH67.25.62.F07.1.454.CMB.2.raw
  modified_base (240)..(240): a, c, t, g, unknown or other
  modified_base (255)..(255): a, c, t, g, unknown or other
  modified_base (300)..(300): a, c, t, g, unknown or other
  modified_base (337)..(337): a, c, t, g, unknown or other
  modified_base (347)..(347): a, c, t, g, unknown or other
  modified_base (358)..(358): a, c, t, g, unknown or other
  modified_base (367)..(367): a, c, t, g, unknown or other
  modified_base (397)..(397): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctctatgaggtgacacagccaccctcggtgtcagtcgtccccaggacagacggccaggatcacctgctctgganatgctttgaccaaanaacaaatatggttactggtaccagcagaaggcggccaggcccctntattagataatatatctaggactcgtaaagacgcctnagggactccngacgcgattcnctggctccngcgacgacgggtaacaactgtacactattnacctatctaagttggacgtaccaagtccgaggacggaccgtaaggggccctacgggggtaaacttaatttaaaccgtcgggtttaacgtaacgttaccgtaaacggtaaaccgacccgtaacccctaaccccgtaaccttaacccgtaaccgtaaccgggttaccgggtacccgggttaccgggggaaccgggtaaaccgggaacccgttaacggttacccggttaacccgggtacccggtttcccggttacgggtacccgaacccggtaaccccggttaaaccgggtccccg

SEQ ID NO: 437691 - DNA, 587 bp, Homo sapiens
  misc_feature: GZ8MTXP01CNRRR.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctcgtggagatgtctttgacccaaacaacaatatggttactggtaccagacaaggaaggccggaccacggcccctatatgataatatatctaggactctaagacggcccctagacgggactcccgtagaccgtcgtattctcgtcggcctacccgaagccgacgagggacacgtgtcaacgtattcgaaccatctagttgacgtccacgcgtggacgacgaggctaggtacttagttactggtacctagtacgagtacgaccgaccacctactactccacggttccgtcggttcgggacggacggaccgttaacgcgtaacgcccgtcgttcgacaccgtccgaacgtcccg

SEQ ID NO: 437692 - DNA, 661 bp, Homo sapiens
  misc_feature: GZ8MTXP01DWJHT.25.62.F07.1.454.CMB.2.raw
  modified_base (299)..(299): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctcgtggagatgtctttgaccaacacaatatggttactggtaccagcagaaggcggccaggcccctntatgatatatatctggactctaagacgccctagaggtactccctgacgcgtattctcgtggccttcgaagcgacgaacggggaaccaacgtgtacctactaagtttacgaacccatacgaagtttacgggacgttacccacgacccgtaggaacgggaccggaagggtcttacggggtaactttattacccgttagttacgacgttccgaaggttaacggaccctacccaaccctaacctccgtaacccgtacgttcccggtacgggttcccgggacggggaacgggaacccgaaacgttccgtaaccgggaaccccgtttccggtttacggacccgacggtaaccccgaacgggtcccccg

SEQ ID NO: 437693 - DNA, 513 bp, Homo sapiens
  misc_feature: GZ8MTXP01BQJNW.25.62.F07.1.454.CMB.2.raw
  modified_base (357)..(357): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagagccctgaggatccctgacgcgattctctggctccngcgcagggacaacgtgtcacattgaccatcattgagtcagcctgagacgaggctggacttattactgtcagtcagtacgacgtccaccactctcacgttcgacgttcggacggacgggacgagctcgaccgtctcggtcacggcccgaaggtcccg

SEQ ID NO: 437694 - DNA, 552 bp, Homo sapiens
  misc_feature: GZ8MTXP01C4UIN.25.62.F07.1.454.CMB.2.raw
  modified_base (242)..(242): a, c, t, g, unknown or other
  modified_base (299)..(299): a, c, t, g, unknown or other
  modified_base (484)..(484): a, c, t, g, unknown or other
  modified_base (496)..(496): a, c, t, g, unknown or other
  modified_base (523)..(523): a, c, t, g, unknown or other
  modified_base (537)..(537): a, c, t, g, unknown or other
tcagactgtacagtcacgaccggtgctcgatttagtagtcgcataaagggaaaggggggggaggcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgtctttgccaacacaatatggttactggtaccagcagaaggcggcacggcccctntatgataatatatcgtggactactaagacgcccgtcgagggactcccgtagacgtccgtatttccgtcgtggtccctcccgaacggccgacgaacggggaacaacgtcggtacaacgtattcgaacctaatcaagttggacttccagcctaggagacgagctaggacttatctgcagtcagtacncgccacacgtcncacgttcgtcgttcggacggacggacngctcgacgtctcgnacgtccgaagtcccg

SEQ ID NO: 437695 - DNA, 513 bp, Homo sapiens
  misc_feature: GZ8MTXP01AZ4J7.25.62.F07.1.454.CMB.2.raw
  modified_base (293)..(293): a, c, t, g, unknown or other
tcagactgtacagtcacgaccggtgctcgatttagtagtcgcataaagggaaagggggggagcctagctgtgctgtgggtccaggaggcagaactctgggtgtctcaccatggtctgggtccctctacttctccccctcctcactctctgcacagggtctgaggcctcctatgaggtgacacagccaccctcggtgtcagtgtccccaggacagacggccaggatcacctgctctggagatgctttgccaacacaatatggtactggtacagcagaaggcggccaggcccctntattgataatatatctggactctaagaggccctgagggatccctgacgcgattctctggcctcaagcgcgagggacaactgtcacattgaccatcattggagtccagcctagagacgagctaggactattactgtcagcagtacgcgccaccactactcacggttcgacgttcggcggaacggcgaagccgtgaccgtcttaggcacgtccgaaggtccc

SEQ ID NO: 437696 - DNA, 532 bp, Homo sapiens
  misc_feature: GZ8MTXP01EOQHA.25.62.F07.1.454.CMB.2.raw
  modified_base (469)..(469): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagacggccctcgagggatccccgtgacgcgtattctctcggctccaagcgcgaagggacaactcgtcacattgaccatctattggagtccagccgtgacggacgagctggacttagttactgtcagtcgagtacgaccgcccactctacncacgttcgcgttcggcggagggaccgagccgtgaccgtccgttggtcacgtcccgaaggtccc

SEQ ID NO: 437697 - DNA, 543 bp, Homo sapiens
  misc_feature: GZ8MTXP01BSXCU.25.62.F07.1.454.CMB.2.raw
  modified_base (239)..(239): a, c, t, g, unknown or other
  modified_base (361)..(361): a, c, t, g, unknown or other
  modified_base (480)..(480): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgccaacacaatatggttactggtaccagcagaaggcggccaggcccctctatgataatatatctggactctaagcggccctcgagggatcccgtgacgcgtattctctggctccngcgcgagggacaactgtacactattgacctatcattggaacgtccagccgtaggacgacgaggtacctgggaactttattaccgtgtacagtccgagttacggacctccaccacctacnctacgttcgcgttcggacggaggacccgagcctggcccgtcttcggcacgcccgaaggtcccg

SEQ ID NO: 437698 - DNA, 614 bp, Homo sapiens
  misc_feature: GZ8MTXP01DH8DW.25.62.F07.1.454.CMB.2.raw
  modified_base (297)..(297): a, c, t, g, unknown or other
  modified_base (379)..(379): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtcccaggacagacggcaggatcacctgctctggagatgtcttgaccaacacaatatggttactggtaccagcagaaggcggccaggcccctntatagataatatatctggactacgtaagacggccctagacgggtactcccgtgacgccggtatttccgtctcgggcctaccnggcgcgggaacgggaacctaacgtcgtacaacttagttcaactactacgtagttacgacgttcgacgtccgtaggacgtacgacggtcctaggggtaacttaacgttaacgtcgtacgacgttacgaagtaaccgccgtacccaactacctactcgtaacggttcggtcggacgggaacgggcggaaaacgcgacgtcgtaccgtcggttacgacgaccgtccgaacggtccccg

SEQ ID NO: 437699 - DNA, 512 bp, Homo sapiens
  misc_feature: GZ8MTXP01ADDFU.25.62.F07.1.454.CMB.2.raw
  modified_base (360)..(360): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagacggccctgagggatcccgtgacgcgattctctggctccngcgcgagggacaactgtcacattcgaccatcattggagtccagcctgaggacgaggctaggggactattactgtcagtcagtagaccgccaccactctcacgttcgcggttcgcggaggccgagctcgacgtctgtcacgccgaaggtcccg

SEQ ID NO: 437700 - DNA, 716 bp, Homo sapiens
  misc_feature: GZ8MTXP01ERFLK.25.62.F07.1.454.CMB.2.raw
  modified_base (296)..(296): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggtactggtaccagcagaggcggccacggcccctntatgataatatatctggactctaagacgcctacgagggactcccgtgacgcgtattctcgtcggacctccaaggccgacgacggggacctaaacgtcgtacaactattacgacctatacctagttcgggtaacgttccccgaaggtcccgtagggaacgggtaccggaaggggtccctttagggggtaaacctttaagttttaaccgttcgggttaccgtaacggttacccgtaaagggttaaaccggacccggacccctaaaccccgtaaccttaacccgtaaccgtaaccgggttcccgggtcccggggtttaccggggaccggggtaacggggaaccccgaaacggttcccgtaacgggtaccccggtttccgtttacgggtacccgaccggtaacccccgttaaagggtcccccgg

SEQ ID NO: 437701 - DNA, 571 bp, Homo sapiens
  misc_feature: GZ8MTXP01EWC0C.25.62.F07.1.454.CMB.2.raw
  modified_base (330)..(330): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcaggaaggcggccacggcccctctattgataatatatctgactctaagacggccctnagggactcccgtagacgcgtattctctggcctccgaagcgacgacggggacaacgtgtcacgtattagacccatcaagtttggacgttccagcctggaacgacgaggcctagggaacttattacctgtcagtcaacggtacgaccgaccacctactacctcgtacgttcggtccggttcggacgggtacgggacccgagccgtcggaccgttcgttcggacaccgccgttaacgggtcccg

SEQ ID NO: 437702 - DNA, 529 bp, Homo sapiens
  misc_feature: GZ8MTXP01C6O1L.25.62.F07.1.454.CMB.2.raw
  modified_base (271)..(271): a, c, t, g, unknown or other
  modified_base (365)..(365): a, c, t, g, unknown or other
  modified_base (393)..(393): a, c, t, g, unknown or other
  modified_base (445)..(445): a, c, t, g, unknown or other
  modified_base (512)..(512): a, c, t, g, unknown or other
tcagactgtacagtcacgaccggtgctcgatttagtagtcgcataaagggaaagggggggtccaggaggcagaactctgggtgtctcaccatggcctgggtccctctacttctcccctcctcactctctgcacagggtctgaggcctctatgaggtgacacagccaccctcggtgtcagtgtccccaggacagacgccaggatcacctgctctggagatgctttgccaaacacaatatggttactggtaccagcagaaggcggcagccctnatgataatatatctggactctaaagacggccctgagggactccctgagccgtaattctcgtggctcagcccgcaggggacaaacgtgtacactnttgaaccaatcattgggactaccagccngaggacgaggctagactattactgtcagtacagtaggacaccacaacgtacncgacgtcgcgtcggcggaggaccaaggctgaccgtcgttggcacggcccaggctcgcccctggtacncttctcgttccccgtcc

SEQ ID NO: 437703 - DNA, 506 bp, Homo sapiens
  misc_feature: GZ8MTXP01DJ5G4.25.62.F07.1.454.CMB.2.raw
  modified_base (294)..(294): a, c, t, g, unknown or other
  modified_base (328)..(328): a, c, t, g, unknown or other
  modified_base (359)..(359): a, c, t, g, unknown or other
  modified_base (453)..(453): a, c, t, g, unknown or other
  modified_base (472)..(472): a, c, t, g, unknown or other
  modified_base (481)..(481): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctnagggatccctgacgcgattctctggcctccngcgcaggggacaactgtcacattgaccatcattggagtccagcctgagacgaggctgggacttagtactgtcagtcagtaagcgccaccactcncacgttcgcgttcggcggnggacgagcngaccgtcttggtcacgccaaggtcc

SEQ ID NO: 437704 - DNA, 570 bp, Homo sapiens
  misc_feature: GZ8MTXP01EOH3E.25.62.F07.1.454.CMB.2.raw
  modified_base (297)..(297): a, c, t, g, unknown or other
  modified_base (351)..(351): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaaacacaatatggttactggtaccagcagaaggcggcacggcccctntattgataatatatctgactctaagacgcctgaggactccctgacgcgatttcnctcggcctcccgaagccgacgaacgggtaccaaaccgttgacaactatttacgaacccaattcctaagttcgggaactccagcccgtaggacggacgtaggctagggaactttagttacctggtctagtcgagtacgacaccaccactacctcacgttcgtcgttcggcggacggacgaacgcgtcgtaccgtccgttcgtcgacgccgaacgtcccgg

SEQ ID NO: 437705 - DNA, 613 bp, Homo sapiens
  misc_feature: GZ8MTXP01D1G1U.25.62.F07.1.454.CMB.2.raw
  modified_base (297)..(297): a, c, t, g, unknown or other
  modified_base (525)..(525): a, c, t, g, unknown or other
  modified_base (562)..(562): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcggccaggccccctntattgataatatatctaggactctaaagaggccctacagggactcctgacgcgtattctcgtcggccctcaagcgacgaacgggacaaacgtgtacaactagttacaacctatactagttagggaccttaccgacgtccgaggaacggacggtaagggccttagggtaaacctttaatttaaccgtgttacgacgttagaagttaaacgcctacccaacctactaccncgtaacggttcgtcggttcggacggggaacggaacgngaccgtcgtaacccgttcgttacgggcaccggtaacccgaacgggtccccg

SEQ ID NO: 437706 - DNA, 542 bp, Homo sapiens
  misc_feature: GZ8MTXP01A1ACU.25.62.F07.1.454.CMB.2.raw
  modified_base (310)..(310): a, c, t, g, unknown or other
  modified_base (361)..(361): a, c, t, g, unknown or other
tcagactgtacagtcacgaccggtgctcgatttagtagtcgcataaagggaaagggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctcattgataatatatctggactctaagacggccctnagggactccctgagcgattctctgctccagccgcagggacaatcgtacacnttgaccatcattggactccagcctgaggacgagctagacttattctgcagtcagtacgacgccaaccactactccgacgtcgaccgttcggcggagggactcgaaagcttggacccgttcgttacgtcacgcccttaacgggccttccgccccgtacggtccaccgttcttccggttcccc

SEQ ID NO: 437707 - DNA, 629 bp, Homo sapiens
  misc_feature: GZ8MTXP01A7F8I.25.62.F07.1.454.CMB.2.raw
  modified_base (317)..(317): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactntaagaggccctgaggatccctgacgcgattctctggctccaagcgcgagggacaagtcgtacacattgaccatccaattggaacgttccaagtccctaggacgggaccgaaggccgtagggtaaccttaagtttacctggtacgagttaccgaacggttaagaccggtacccaacccgtaaccttaacccgtccaaaccgggttccgtaccgggtttacccgggaccggggtaacggggacccgaaacggttccgtaacggtacccggttccgttcgggtaccaccgggaaccccgttaaacgggtccccgg

SEQ ID NO: 437708 - DNA, 516 bp, Homo sapiens
  misc_feature: GZ8MTXP01DNZRQ.25.62.F07.1.454.CMB.2.raw
  modified_base (295)..(295): a, c, t, g, unknown or other
  modified_base (361)..(361): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacgccaggatcacctgctctggagatgctttgccaaacacaatatggttactggtaccagcagaaggcggccaggcccctntattgataatatatctggactctaagaggccctcaggactccctgacgcgtattctctggactccngcgcagggacaactgtacacattgacctatcattggactccagcctagagacgaggctaggacttattactggtcagtcagtagccgccaccactctcacggttcgcgttcggacggagggaccagctcgacgtcttggcacgcccgaagtcccg

SEQ ID NO: 437709 - DNA, 622 bp, Homo sapiens
  misc_feature: GZ8MTXP01DDMIC.25.62.F07.1.454.CMB.2.raw
  modified_base (226)..(226): a, c, t, g, unknown or other
  modified_base (242)..(242): a, c, t, g, unknown or other
  modified_base (299)..(299): a, c, t, g, unknown or other
  modified_base (309)..(309): a, c, t, g, unknown or other
  modified_base (366)..(366): a, c, t, g, unknown or other
  modified_base (375)..(375): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggntcacctgctcgtgganatgtctttgaccaacacaatatggttactggtaccagcagaagcggccaggcccctntatgataatntatctaggactacgtaagacggcctagacgggactcccgtagaccgcgtattcgtcnggtacctcnggcgacgagggaccaacgtgtccaactattcgaaccctatccaagtttcggaacgtcccgtaagcccttagggacggtacgagggtacccttaggggtaaccctttaagtttaccgtgtaccgaggtttaccaaggttaaccgacccgttacccaacccgtataccgtcgaccgttcggtccggttcggacgggacgttaccgagttccgtcgaccgttcgtgtaccacgtcccgttaaggtccccg

SEQ ID NO: 437710 - DNA, 561 bp, Homo sapiens
  misc_feature: GZ8MTXP01EBUJN.25.62.F07.1.454.CMB.2.raw
  modified_base (324)..(324): a, c, t, g, unknown or other
  modified_base (452)..(452): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccacacaatatggtactggtacagcagaaggcggccaggcccctctatgataatatatctggactctagagccctnaggatccctgacgcggattctctggctccaagcgcgagggacaactgtctacatttgaccatcatttggaagtcctaagcccgttagacgggacgaagggcctaggggactttattaacgtcgtacgngtacctaggtaaacgtcgacccacctaaccctagtctaacggttccgtcggttcggaccggagggacccaggacctggacccgttccgtggtcacgcccttaagggccc

SEQ ID NO: 437711 - DNA, 523 bp, Homo sapiens
  misc_feature: GZ8MTXP01DBMQP.25.62.F07.1.454.CMB.2.raw
  modified_base (296)..(296): a, c, t, g, unknown or other
  modified_base (364)..(364): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcggccaggcccctntattgataatatatctggactctaaagaggccctcgagggactccctgacgcgattctctggcctccngcgcaagggacaactgtcacattgaccatcattggatccagcctgagacgaggctggactattactgtcagtcagtagccgccaccactactcacgttcgcgttcggcggacgggaccagctaacgaccgttcccgttggccacgcccgaacgggtccc

SEQ ID NO: 437712 - DNA, 564 bp, Homo sapiens
  misc_feature: GZ8MTXP01A98PK.25.62.F07.1.454.CMB.2.raw
  modified_base (296)..(296): a, c, t, g, unknown or other
  modified_base (480)..(480): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcaggaaggcggccaggcccctntattgataatatatctggactcgtaagacggccctcgagggactcccgtgacgcgtattctctggcctccaagccgacgagggacaacgtgtacactattcgacccatcattggacgtccagcctaggaggacgagctaggacttattacgtgtcagtcaggtacgaccgtcccaaccactccncgtacgttcgtccggttccggcgggacggaccgaggccgtaacgacccggttccgttcgggaccacggtccccgaaggtccccg

SEQ ID NO: 437713 - DNA, 688 bp, Homo sapiens
  misc_feature: GZ8MTXP01CJ0CS.25.62.F07.1.454.CMB.2.raw
  modified_base (298)..(298): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaacacaatatggttactggaccagcagaaggccggcacggcccctntatgataatatatctgactctaagacgtcctgagggactcccgtagaccgcgtacttctcgtcggccttcccgaaggccgacgacggggacaacgtcgtacaactagttacgacctaattcagttacgggacgttacgaaccccgtcgtagggaacggtaacggaggtaccttaggggtactttaaacgtttcgttacggtacctacggttaccgaaggttaaaccggcccgtaacccaaccctaaccgtaccttaaccgacccggttccgggtccggttaccggggaccggggtaacggggttaacccgaaacggttccgttaaccggaccccggtttccggtttcgggtaacccggacccgggtaaccccgttaaacggggtcccccg

SEQ ID NO: 437714 - DNA, 655 bp, Homo sapiens
  misc_feature: GZ8MTXP01CO04Z.25.62.F07.1.454.CMB.2.raw
  modified_base (242)..(242): a, c, t, g, unknown or other
  modified_base (308)..(308): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccacctcggtgtcagtcgtccccaggacagacggccaggatcacctgctctgganatgtctttgaccaacaactaatagttggttactggtaccagcaaggaaggcggccacggccccctntatagataatatatctaggactctaaagcgcctacgagggactcccgtgaaccgcgtattcgtctcggctcccgaagccgacgaagggacctaaacgtcgtacaactacttcgaaccctataccagtttacgggaacgttcccaagtcccgtagggaacggaccggttaagggtccttaggggtaaacccgttaagttttaaccgtacggtaacgtacgtacgtaacggtaaccgaccccgtacccctaacctaccgttaccgtcgtaccggttcggtaccgggttacgggacggaacgttacgcggcgtccgtccgtcgtcggaccttaccgtaacccgcgtcccg

SEQ ID NO: 437715 - DNA, 627 bp, Homo sapiens
  misc_feature: GZ8MTXP01EQB2A.25.62.F07.1.454.CMB.2.raw
  modified_base (296)..(296): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntattgataatatatctggactctaagacggccctgacgggatcccgtagacgcgtattctctcggcctcccaagccgacaggggacaactgtacactattcgaccatctaatggtaacgtccagccaggaggaccgaaggtctaggaattaacttacgtcggttaccaagttcaacgttaacggacccgtacccaacctacctaaccctcgaaccggttccggtccggtttaccgggacggggaacgggaacccgaaacgggttcccgtaaccgggtaacccggttcccgtttcgggtccgaaccggaacccccgttaaagggtcccccgg

SEQ ID NO: 437716 - DNA, 540 bp, Homo sapiens
  misc_feature: GZ8MTXP01C3Y4G.25.62.F07.1.454.CMB.2.raw
  modified_base (275)..(275): a, c, t, g, unknown or other
  modified_base (368)..(368): a, c, t, g, unknown or other
  modified_base (492)..(492): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggcaggccctnattgataatatatctggactctaaagacggcccctagagggactccctgacgcgtattctctggcctcagcccgcgagggacaactgtacacngttcaccatcattggactccagcctaggacggacgaggctagtacttattacgtgtacagtcaagtagaccgccaaccactacctcgacgtcgcgtcggacggaggaccaagctgacccgttcncgtcacgcccgaggcctccgcccctggccacttcctcgttcccgtccc

SEQ ID NO: 437717 - DNA, 598 bp, Homo sapiens
  misc_feature: GZ8MTXP01A8W9H.25.62.F07.1.454.CMB.2.raw
  modified_base (295)..(295): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctaggactactaagacggccctacgaggactcccgtgacgcgtattctctggcctcgaagcgacgagggacaactgtacacattcgaacctatcagttggacttccaagtcctaggacgaacgagggtcctggtaacttagttacctggtccagttcaaggtaacgccgtaccacctactacctcgtaacgttccggtcgggttcggacggggacggaacccgttacgacccgttgggaaccccgtttccgtttacgggcccgaccggccccgttaaagggtcccccgg

SEQ ID NO: 437718 - DNA, 528 bp, Homo sapiens
  misc_feature: GZ8MTXP01C7CF9.25.62.F07.1.454.CMB.2.raw
  modified_base (298)..(298): a, c, t, g, unknown or other
  modified_base (366)..(366): a, c, t, g, unknown or other
  modified_base (449)..(449): a, c, t, g, unknown or other
  modified_base (474)..(474): a, c, t, g, unknown or other
  modified_base (494)..(494): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcgggccacggcccctntattgataatatatctggactctaagaggccctcgagggactccctgacgcgtattctctggcctccngccgcgaaggggacaactgtcactattcgaaccatcagtttgggaacttccagccctggaggacgaggctgggactatttacngtcagtcagtacgcgccacactacncacgttcgcgttcggacggnggacagctgaccgtcgttggcacgccgaaggtcc

SEQ ID NO: 437719 - DNA, 550 bp, Homo sapiens
  misc_feature: GZ8MTXP01COPGJ.25.62.F07.1.454.CMB.2.raw
  modified_base (294)..(294): a, c, t, g, unknown or other
  modified_base (314)..(314): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggcaggatcacctgctctggagatgcttgccaaacacaatatggttactggtaccagcagaaggcggccaggcccctntatgatatatatctggactntaagacggccctgagggactcccgtgacgcgattctctggcctccaagcgcaaggggacaactgtcactattacgacctatctagttcggagtccagccctaggacgacgaggctaggaacttagttactgtacagtcagtacgcgtccaccactactccgaccgttcggtcggttcggacggtggacccgaagcgtaacgaccgttccgtggtaccgacgccccgaaggtccccg

SEQ ID NO: 437720 - DNA, 532 bp, Homo sapiens
  misc_feature: GZ8MTXP01C6YWH.25.62.F07.1.454.CMB.2.raw
  modified_base (296)..(296): a, c, t, g, unknown or other
  modified_base (319)..(319): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcggccaggcccctntattgataatatatctaggactntaagacggccctcagggactcccgtgacgcgtattctctggcctcaagcgcaaggggacaactgtcacattgaccatcagttggaatccagccgtgaggacgaggctgggaacttattacctgcagtcagtagacgccacactactcacgttcgtcgttcggcggacggaccgagctaacgaccgttcgttcgggcaccgccgaacgggtccc

SEQ ID NO: 437721 - DNA, 745 bp, Homo sapiens
  misc_feature: GZ8MTXP01CEF8L.25.62.F07.1.454.CMB.2.raw
  modified_base (297)..(297): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgtctttgaccaaacacaatatggttactggtaccagcagaaggcggcacgcccctntatgataatatatctggactctaagcggccctagagggactcccgtgaccgcgatttctcgtggccttccgaagccgacgtaggggaaccaacgtcggtaccaactagtttacgaaccctatccgtaagtttcgggaacgttccccgaaggtcccgtagggaacgggaaccggacgggtaccgtttacgggggtaaaccctttaagtttaaaccggttcggttaaccgtacggttaccgaacgggtttaaaccgggaccccgttaaccccaaaccccttaaaccgttacccgttaacccggtaaaccgggttacccgggtcccggggtttacccggggaaccgggggtacggggttaaaaccccgaaacgggttcccgttaacccgggtaaccccggttcccggttacgggttacccgaccgggttaacccccgaaggggttcccccg

SEQ ID NO: 437722 - DNA, 573 bp, Homo sapiens
  misc_feature: GZ8MTXP01DNXF2.25.62.F07.1.454.CMB.2.raw
  modified_base (297)..(297): a, c, t, g, unknown or other
  modified_base (319)..(319): a, c, t, g, unknown or other
  modified_base (362)..(362): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcagaaggcgggccaagcccctntattgataatatatctggactntaagagccctgagggactccctgacgcgattctctggcctccngcgcgagggacaacgtgtacactattcgaccatctagtttcgggaacgttcccaagtcccgtggaacgggacgaagggtcctagggtaacttattaaccgtggtaccagtcgagtaacgccgaccaccactactcacgttcggtaccgttcggacgggaggacccgagccgtaacgaccgttccgttcggacaccgtcccgaagggtcccc

SEQ ID NO: 437723 - DNA, 558 bp, Homo sapiens
  misc_feature: GZ8MTXP01EGB7T.25.62.F07.1.454.CMB.2.raw
  modified_base (296)..(296): a, c, t, g, unknown or other
  modified_base (317)..(317): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntatgataatatatctggactntaagacggcctagaggactccctgacgcgtattctctggcctccaaggcgcgacgggacaacgtcgtacacattcgacctatcagttggaacgttccagcctggacgacgacgctaggacttattacctgtcagtcgtagtacgacgacccaccacctactctaacgttcggcggttcgggcgggaacgggaccgagccgtcgtacccgtcgtttcgggacacggcccgttaaggtccccg

SEQ ID NO: 437724 - DNA, 646 bp, Homo sapiens
  misc_feature: GZ8MTXP01A4OZJ.25.62.F07.1.454.CMB.2.raw
  modified_base (363)..(363): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagacggcctcgagggactcccgtgacgcgtattctctggctccngcgacgagggacaacgtgtacgactattcgacctaatcctagttcggaacgtcccgaagcccgtaggaacgggacggaagggtcgtacggggactttaatttacgtacggtactaagtcgaacgttacggaccgtacccaaccctacctacctaaccgaaccggttcggtaccggtttaccggggaccggggtaacggggaaccccgttaaaggttcccgttaacggtaaccccggtttccgtttacggggacccacgggtccccgttaaacggggtcccccg

SEQ ID NO: 437725 - DNA, 682 bp, Homo sapiens
  misc_feature: GZ8MTXP01ARMAY.25.62.F07.1.454.CMB.2.raw
  modified_base (295)..(295): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcacggcccctntatgataatatatctggactcgtaagacggccctgagggactcccgtgacgcgtattctcgtggacctccgaagcgacgaacgggacctaacgtcgtacactatttacgaccctaatcctaagtttgggaacgttccgaacgcccgtaggacgggtaaccggagggtctacggggtaacttaacgttaacgtcggttaccaaggttccgaaggttaaccgacccgcccctaaaccctaccgtacccgtaacgtaaccggttccggtacccgggtttaccggggaccggggtaacgggaaccccgaaacggttcccgttaaaccgggtccccggtttccggtttcggggtacccaccgggtaacccccgttaaagggggttccccccg

SEQ ID NO: 437726 - DNA, 628 bp, Homo sapiens
  misc_feature: GZ8MTXP01ATSG3.25.62.F07.1.454.CMB.2.raw
  modified_base (296)..(296): a, c, t, g, unknown or other
  modified_base (342)..(342): a, c, t, g, unknown or other
  modified_base (533)..(533): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgcaacacaatatggttactggtaccagcagaaggcggccaggcccctntatgataatatatctggactctaaagacgccctgagggacttcccngacgcgatttcgtctaggcctccaaggcgacgaaggggaaccctaaacgttcggacctaactaagtttcggaaccctagtccaagtttcgggaacgttcccaaggtccgtaggaacgggacgagggtcctagggtaacttattaacctggtactacgttcgaagtaccgaccgtccaacctaaccttaccncgtaaccgttcggtcggttaccggcgggaacggaaccgttaggccttaagggaccccgttcgttccgggacaaccggtcccgaaccgggttcccg

SEQ ID NO: 437727 - DNA, 587 bp, Homo sapiens
  misc_feature: GZ8MTXP01CI7PR.25.62.F07.1.454.CMB.2.raw
  modified_base (220)..(220): a, c, t, g, unknown or other
  modified_base (375)..(375): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgaccaacactaatatggttactggtaccagcagaaggcggcaggcccctgtattgataatatatctaggactactaaggacggccctgagggactcccgtgacgcgtattctcgtggctccagcccgacgagggactactgtacactnttcgacctatcagttgggactcgacgtccgtggaggaccgaggctagtacttattacgtgtactagtacgagtaacggggacacccacctactaactccgacgtcggtcggttcgggacggacggaccaagccgtcggacccgtcgttacggcacggcccgagccttcccgccccgtaaggtccacggttccttcccggttcccgtaacccc

SEQ ID NO: 437728 - DNA, 572 bp, Homo sapiens
  misc_feature: GZ8MTXP01DTADW.25.62.F07.1.454.CMB.2.raw
  modified_base (239)..(239): a, c, t, g, unknown or other
  modified_base (298)..(298): a, c, t, g, unknown or other
  modified_base (513)..(513): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacgccaggatcacctgctctgganatgtcttgaccaacacaatatggttactggtaccagcaggaaggcggccacggcccctntatgataatatatctagactacgtaagcgcctgacggactcctgacgcgtattctcgtcggtcctcgaagcgcgaacgggaacacgtcgtacaactatttacgaaccctataccgtaagtttcgggaacgttcccaaggtcccgtagggaacggacgaagggtcctagggtaactttagttacctggtacagtacagtaacgcctaccacactcncaccgttcgccgttcgggacgacgacgagcgcgtaccgtcgtacgcacgccgcgtcccg

SEQ ID NO: 437729 - DNA, 706 bp, Homo sapiens
  misc_feature: GZ8MTXP01ACRQ9.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcccgggtccctctacttctccccctcctcactctctgcacagggtctgaggcctcctatgaggtgacacagccaccctcggtgtcagtcgtccccaggacagacggccaggatcacctgctctggagatgtctttgaccaaacacaatagtggttactggtaccagcgaggaacggcggccacggcccctctattgaataatatatctggactacgtaagacgccctcgaggactcccgtgacgccgtattcgtcgtcggcctaccgacgcgcgaacgggacaacgtcgtacaactattacgacctatacgtagttgggaacgtccgaacgtccgtagggaacgggaccgttaagggcttacggaacctttaagttaccgttagtacccgtaggtttacccaagggtaaccggaacccgtaacccctaaaccccgtaacgttaaaccctttcccgggaaaccggtttcccggggttcccggggtttccgggggaaccggggtaaccgggggtaaacccaacgggttcccgttacgggtaaccccgttccgttaagggacccaccggaccccgaacggttcccgttcccccgg

SEQ ID NO: 437730 - DNA, 687 bp, Homo sapiens
  misc_feature: GZ8MTXP01C51I3.25.62.F07.1.454.CMB.2.raw
  modified_base (296)..(296): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntatgataatatatctggactctaagacggccctacgaggactcctgacgcgattctctcggcctccaacgcgacaggggacaactgtacacattacgaccctatcaagtttcggacgttcccgaagtcccgtaggagggaccggaggtccctaggggtaaccttagtttaacgttcggtacgtaacgttaccgaaggtttaaaccggacccgtaccccgaaccccgtaacctacccgttaaccgtaacccggttccgggtcccgggttccggggtaaccggggtacgggggttaaacccgaaacggttcccggtaaccgggttaaacccccggttcccgtttttacggggtaccccgaccgggtaaccccccggaaacggggttcccccgg

SEQ ID NO: 437731 - DNA, 511 bp, Homo sapiens
  misc_feature: GZ8MTXP01EZ75J.25.62.F07.1.454.CMB.2.raw
  modified_base (295)..(295): a, c, t, g, unknown or other
  modified_base (329)..(329): a, c, t, g, unknown or other
  modified_base (431)..(431): a, c, t, g, unknown or other
  modified_base (442)..(442): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctnagggatccctgacgcgattctctggctccaagcgcagggacaactgtacacattgaccatcattggactccagcctgagacgaggctgggactattactgcngtcagtacgcnccaccactactcacgttcgcgttcggcggagggaccagctgaccgtccgttggcacgcccgaaggcccg

SEQ ID NO: 437732 - DNA, 600 bp, Homo sapiens
  misc_feature: GZ8MTXP01EZ9FI.25.62.F07.1.454.CMB.2.raw
  modified_base (268)..(268): a, c, t, g, unknown or other
  modified_base (296)..(296): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaacacaatatggttacnggtacagcagaggcggccacggcccctntatgataatatatctggactctaagacggccctacgagggactcccgtagacgcgtattcgtctggccttccgaagcgcgaggggacaacgtgtacacgtattagaccattcagttggacgtccagccctaggacggacgaggcctagggtacttagttactgtacagttcgaggttaacgaccgaccccacctaccttactccgtaccggttcgggtccggtttcggggaccgggaacggggaaccaaggcccgtaaggtaccccgttcgttcgggtccgaccggtccccgaacgggtccccg

SEQ ID NO: 437733 - DNA, 651 bp, Homo sapiens
  misc_feature: GZ8MTXP01D0OJP.25.62.F07.1.454.CMB.2.raw
  modified_base (245)..(245): a, c, t, g, unknown or other
  modified_base (312)..(312): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacacgcccacccgtcggtgtcagtcgtccccaggacagacgccaggatcacctgctcgtgganatgtcttcgaccaacacaatagtggttactggcaccagacgaggaacggccggaccaccggcccctntattagaattaatatatctacggactactaaggacgtccctacgaggtactcccgtaggacgtacgtacttcctcgtacgggccctccgacgccgaccggaacgggacctaacgtcgtaccacgtattaccggactacgtctaaggtttacgggactaccaggtcccgaagggacggacgtacgtcggtaagtactttaacgttacgtgtactacgtacgaaacgtccgaacccacccctaaacctcctaaaccgtcgttaccggtccggttaccgggtaccgggacgaacgggttccaacggtcgtacgtccgtacgtcgacaaccggaaccgtccgg

SEQ ID NO: 437734 - DNA, 512 bp, Homo sapiens
  misc_feature: GZ8MTXP01AVYHS.25.62.F07.1.454.CMB.2.raw
  modified_base (294)..(294): a, c, t, g, unknown or other
  modified_base (417)..(417): a, c, t, g, unknown or other
  modified_base (470)..(470): a, c, t, g, unknown or other
  modified_base (476)..(476): a, c, t, g, unknown or other
  modified_base (497)..(497): a, c, t, g, unknown or other
  modified_base (510)..(510): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntatgataatatatctggactactaagaggccctgagggtactcccctgaaccgcgattctctggcctcccgaagcgcagggactaactgtcacattgaaccatcattggactccagcctgagngaggcgacgtattactgtacagtcagtagacgcctacacgtactcaacgtcgngtcggngagccagttcacgcgtctgcncgccaaggttccncg

SEQ ID NO: 437735 - DNA, 757 bp, Homo sapiens
  misc_feature: GZ8MTXP01CYALU.25.62.F07.1.454.CMB.2.raw
  modified_base (300)..(300): a, c, t, g, unknown or other
  modified_base (374)..(374): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgtctttgaccaacacaatatggttactggtaccagcagaaggcggccacggcccctntattagataatatatctaggactcgtaagacgccctagagggtactccgtgacgcgtattctcgtcggcctcgngccgacgaacgggaacctaacgtcgtaccaactacttacgaaccctataccgtaagtttacggggaaccttacccgaacggtacccgtagggaacgggtacgaaacggggtcccttaaggggtaaaccctttaagttttaacccgtggttaaccgtaaacggttacgtaacggttaaaccgggaaccccgtaccccaaacccgttaaccttaacccgtaaccggttaaacccggggttcccgggtccggggttcccgggggaaaccgggggtaaccggggaaaaccccgttacggggttaccccgttaacccgggtaacccccggtttccggtttaacgggtacccgaaccgggttaaccccccggaaacggggttcccccgg

SEQ ID NO: 437736 - DNA, 679 bp, Homo sapiens
  misc_feature: GZ8MTXP01AX6J5.25.62.F07.1.454.CMB.2.raw
  modified_base (240)..(240): a, c, t, g, unknown or other
  modified_base (298)..(298): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcactgctctgganatgtctttgaccaacacaatatggttactggtacagcagaaggcggccacggcccctntatgataatatatctaggactacgtaagacgccctagacggactcccgtgacgtcgtacttctcgtcggacctccgaaggcgtacgacggggacctaacgtcggtacaactagttacgaaccctagtacctagtttacggaaccgttccaaggtccccgtaggaacgggaaccggtaggtaccgttaggtaaacgtttacgtttaaccgtcgtaacgtacgtaccgtaaggtaacggacccgtacccaaccttaaccctaacttcccgaaccgggttccggtacccgggtttccggggaacggggtaaccgggaaccgttacggcccgttaacgggtacccgttcgttacgggaccaccggtaacccgaacgggttccccg

SEQ ID NO: 437737 - DNA, 677 bp, Homo sapiens
  misc_feature: GZ8MTXP01B9BAM.25.62.F07.1.454.CMB.2.raw
  modified_base (301)..(301): a, c, t, g, unknown or other
  modified_base (338)..(338): a, c, t, g, unknown or other
  modified_base (372)..(372): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccacctcggtgtcagtcgtccccaggacagacggccaggatcacctgctcgtggagatgtctttgaccaaacacaatatggttactggtaccagcagaaggcggccacggcccctntatgataatatatctaggactacgtaagacgccctanagggactccctagacgcgtattctctggccacgngcgccgtaagggacaatgacactattacacctatccgagttacggacgtcgacgccgtagaacggaccgaggacgttacgggaaacctttatttaacgcgttaacccgtagtacgaaccggtttaaacggaccccgtaccccaaccccgtaaccgttaccctttaaccggaacccgggttacccgggtaccgggtttcccggggaaccggggtaacgggttaacccccgaagggttcccggtaacggtaaaccccggttccccggtttggacccgaccggtaacccccgaacgggttccccccgg

SEQ ID NO: 437738 - DNA, 596 bp, Homo sapiens
  misc_feature: GZ8MTXP01DOLND.25.62.F07.1.454.CMB.2.raw
  modified_base (479)..(479): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaacacaatagtggttactcggtaccagacaggaaggcggccacggcccctatatgaatatatatctggactacgtaagacggccctacgagggactcccgtagacgcgtattctctcggctcaagcgacgagggacaactcgtacactattagaccatacaagttggaacgttcccagtccaggacggaacgacgggtactaggggtaacttagttaacgtcgtanacgtcaaggtaacgacccgccacctaacctacctcgaccgttcggtcgttacgggcggacgttacgggacccttaaggccttcgaacccgtttcgtacggctaaccgaaccgtaacg

SEQ ID NO: 437739 - DNA, 669 bp, Homo sapiens
  misc_feature: GZ8MTXP01B8KLM.25.62.F07.1.454.CMB.2.raw
  modified_base (242)..(242): a, c, t, g, unknown or other
  modified_base (273)..(273): a, c, t, g, unknown or other
  modified_base (306)..(306): a, c, t, g, unknown or other
  modified_base (383)..(383): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctgganatgtctttgaccaaacacaatagtggttacnggtaccagacaggaacggcggccacggcccctntatgataatatatctaggactcgtaagacggccctgagggactcccgtagaccgcgtattcgtcgtggccctaccgngccgacgaacggggaccaaacgttcgaccaactacgtttacgaaccctagtccgtaagtttcgggaaacgttcccgaacggtcccgtagggaacggaacggtacgggtaccttacggggtaactttaacgtttaccgtagttacccgtaagttcgaacggttaacgacccgacccacctactaccctccgtaccggttccggtcggttccgggaacgggacgggttaaccgacggttctccggtacccgttccgttcggccaccggaaccccgaacgggtcccccg

SEQ ID NO: 437740 - DNA, 595 bp, Homo sapiens
  misc_feature: GZ8MTXP01AJPGI.25.62.F07.1.454.CMB.2.raw
  modified_base (323)..(323): a, c, t, g, unknown or other
  modified_base (341)..(341): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctattgataatatatctggactctaagnggccctgagggactcccngacgcgtattcgtctggcctccgaagcgcgagggacaactgtacactacttgaccctatcaagtttggaacgttccaagtccgtaggacggacgaggtctacggggtacttagttacctgtactagtcagttacgaccgtccaaccctactaccgtctaaccggttcggtccggttcgggaccgggacgggacccgaacgttcgttaaccgaccggttcccgttggtacccgacggtccccgaacggtccccgg

SEQ ID NO: 437741 - DNA, 659 bp, Homo sapiens
  misc_feature: GZ8MTXP01DVD8X.25.62.F07.1.454.CMB.2.raw
  modified_base (293)..(293): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggcaggatcacctgctctggagatgctttgaccaacacaatatggttactggtacagcagaggcggccaggcccctntatagattaatatatcgtggactacgtaagacggcccctagagggtactccccgtgacgcgtatttcgtctggcctccgaaggcgacggaacggggacctaaacgtcggtactacctagtttcgacccatcgtaagtttgggaaacgttcccaagtcccgaggacgggtaacgaggtccgtagggtaacttatttaacctggttaccaagttccgaaggttacggaccgtccctaaccactccgttaaccgaaccggttcggtcccgggtttcgggaaccgggtacggggttaacccgaaacgcccgttccggtaaccccgttcccgtttaacggcccgttacgtccccgaaacggggttcccccg

SEQ ID NO: 437742 - DNA, 710 bp, Homo sapiens
  misc_feature: GZ8MTXP01B1M4T.25.62.F07.1.454.CMB.2.raw
  modified_base (298)..(298): a, c, t, g, unknown or other
  modified_base (367)..(367): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaacacaatatggttactggtaccagcagaaggcggccacggcccctntatgataatatatctggactctaagacggccctgagggactcccgtgacgcgtattctctggcctccgngcgacgagggacaacgtgtcaactattacgaacctataccaagtttgggaacttccgaacgtcccgtaggaacgggtaaccggaaggggtcccttagggggtaaccctttaagttttaaacccgtgggttaccctaaggtttaccgaaacggtttaaaccgggacccgtaccccaaaccccgtaaacccttaaccgttcccgaaacccggtttccggtacccggggttttccggggaaccgggggtaacggggaaccccgttaaaagggttccccgttaacgggtacccccggttcccgttttacggggcccgaaccggtaaccccgaaacgggttcccccgg

SEQ ID NO: 437743 - DNA, 525 bp, Homo sapiens
  misc_feature: GZ8MTXP01DBMYZ.25.62.F07.1.454.CMB.2.raw
  modified_base (296)..(296): a, c, t, g, unknown or other
  modified_base (345)..(345): a, c, t, g, unknown or other
  modified_base (396)..(396): a, c, t, g, unknown or other
  modified_base (436)..(436): a, c, t, g, unknown or other
  modified_base (444)..(444): a, c, t, g, unknown or other
  modified_base (454)..(454): a, c, t, g, unknown or other
  modified_base (496)..(496): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggcaggatcacctgctctggagatgtctttgccaaacacaatatggttactggtaccagcagaaggcggccaggcccctntatgataatatatctggactctaaagaggccctcagggactccctgacncgattctctggcctccaagcgcgaagggacaactgtcactattgacctaanctattggaagtccagcctgaagcgagctggaactattacngtacagtnagtaacgacnccaacacacgtcacgttcgcggttcggcggaggaccagttcnggacctccgttggcacgcccaagggtccc

SEQ ID NO: 437744 - DNA, 686 bp, Homo sapiens
  misc_feature: GZ8MTXP01D6IG5.25.62.F07.1.454.CMB.2.raw
  modified_base (292)..(292): a, c, t, g, unknown or other
tcagactgtacagtcacgaccggtgctcgatttagtagtcgcataaagggaaaggggggggtccaggaggcagaactctgggtgtctcaccatggcctgggtccctctacttctccccctcctcactctctgcacagggtctgaggcctcctatgaggtgacacagccaccctcggtgtcagtcgtccccaggacaggacggccaggatcacctgctcgtggagatgtctttgaccaaacactaaattagtggttactggtaccagcaaggaacggcgggccacggcccctntatgattaatatatctggactctaaagcggccctgagggactcccgtgagcgtattctcgtggcctcgagcccgacgagggacaactcgaacactgttcgacctatctagttagggacgttccagtccgtagggacgggacgacgggcttaaggtaccttaattaccgtgttacgacgttactaacggtaaccggggaacccacccaaaccctactaccgttccgaccggttcgtacccggggttccgggacggggtaaccggggaaaccctaaggtccgttcggacccggtttccgttacggggacccaacggttaccccggaaggttcccctaacccgtccccccggttaaggtccctacccgttccgttccccggttcccccgttcccccg

SEQ ID NO: 437745 - DNA, 556 bp, Homo sapiens
  misc_feature: GZ8MTXP01EV8V6.25.62.F07.1.454.CMB.2.raw
  modified_base (240)..(240): a, c, t, g, unknown or other
  modified_base (297)..(297): a, c, t, g, unknown or other
  modified_base (362)..(362): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgaccaacacaatatggttactggtaccagcagaaggcggccaggcccctntatgataatatatctgactctaagacgccctgagggactccctgacgcgtattctctggcctccngcgcgagggacaactgtcaacattcgaccatcattggaactccagcctaggacgacgagctaggacttaattactgtcagtcgagtacgacgtccacctactacctcgtaacgttcgccggttcgggacgggaacgggaccgacggttcgtcgtaccccgttccgttcggtccgaccgcccgaacgggtccccg

SEQ ID NO: 437746 - DNA, 674 bp, Homo sapiens
  misc_feature: GZ8MTXP01BA60I.25.62.F07.1.454.CMB.2.raw
  modified_base (199)..(199): a, c, t, g, unknown or other
  modified_base (243)..(243): a, c, t, g, unknown or other
  modified_base (273)..(273): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtntcagtcgtccccaggacagacgccaggatcacctgctcgtgganatgtctttgaccaaacacaatatggttacnggtaccaggcaggaaggccgggaccacggccccctatattgataatatatctggactcgtaaagcggtcctagagggtactcccgtagacgcgtatttctcgtcggaacctccaaggcgtacgaagggaccaacgttcgacactacgttcgaccctataccagttgggacgttccagtccgtaggacgggaacgacggtacgtaggggtaaccttagtttaaccgtcgttacgaagttacggaacgttacggaccctaccccaaccctaaccttaaccgttccgaaccgggttccggtccggtttaccgggggaccggggtaacgggaacccgttaacgttcccggttaaccgtacccggttccgtttcgggaccaccggaaccccgttaagggtcccccg

SEQ ID NO: 437747 - DNA, 621 bp, Homo sapiens
  misc_feature: GZ8MTXP01BF1SM.25.62.F07.1.454.CMB.2.raw
  modified_base (239)..(239): a, c, t, g, unknown or other
  modified_base (297)..(297): a, c, t, g, unknown or other
  modified_base (312)..(312): a, c, t, g, unknown or other
  modified_base (365)..(365): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacgccaggatcacctgctctgganatgtctttgaccaacacaatatggttactggtaccagcagaaggcggcacggcccctntatgataatatatcnggactcgtaagcgtcctgaggactcccgtgacgcgtattctcgtggcctccgngcgacgacgggacaacgtgacactattacgacctatctagttcggaactccgaagtcccgtaggacggacggtaacgggtctacggggtaactttacgttaccgttgtaccgaagttcgaagtaacggacctacccaacctacctaccgtaacctaaccggttcggtaccggttacgggaccgggtacggaaccgacggttccgttaaccggtacccggttccgttacggccgaaccggccccgttaaggtccccg

SEQ ID NO: 437748 - DNA, 550 bp, Homo sapiens
  misc_feature: GZ8MTXP01C7W53.25.62.F07.1.454.CMB.2.raw
  modified_base (258)..(258): a, c, t, g, unknown or other
  modified_base (304)..(304): a, c, t, g, unknown or other
  modified_base (460)..(460): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgtctttgaccaaanacaaatattggttactggtaccagcaggaaggcggccaggcccctntatgaataatatatctaggactactaaagcggccctgagggactcccgtgacgcgtattctctcggctccgaagcgacgaagggacaactgcaactattcgaccatcattggacgtccagccgtagacgacgaggtctaggtacttattactcgtntacgtcaggtaacacgacccaccactactcacggttcgacgttcgggacggaggaccgagctgaccgtcttcggcacgtcccgaaggtcc

SEQ ID NO: 437749 - DNA, 716 bp, Homo sapiens
  misc_feature: GZ8MTXP01D3CLC.25.62.F07.1.454.CMB.2.raw
  modified_base (284)..(284): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtccccaggacaggacggccaggatcacctgctctggagatgtctttgacccaaacaacaattatggttactggtaccagcaaggaggcggccaggcccctntatgaataatatatctggactacgtaaagacgcccctgagggactcccgtgacgtcgtattcctcgtcggtctccagcccgacgtaagggactaacgtgtaaacccactaacgttcgaaaccctattaccgtaagtttcggggaacgttacccgacggtccgtaggaacgggacggtagaccgttacgtaacctttattaccgtaggttaccaggttacgtaaacgttacggaacccgtacccaacctaacccttaccgtccgtaacccgtcgggtccggttcggggaccgggtaaccgggaaccgaacggtcgtccggttaacccggttccgttccgggtacctaaccgggaccccgttaacgggttcccgtcccggtccccccgttcgggttaccctcccgttccgtttcccgttaacccccgttccccc

SEQ ID NO: 437750 - DNA, 734 bp, Homo sapiens
  misc_feature: GZ8MTXP01ACZNI.25.62.F07.1.454.CMB.2.raw
  modified_base (307)..(307): a, c, t, g, unknown or other
  modified_base (330)..(330): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctcgtggagatgtctttgacctaacacaatagtggttactggtaccagcaggaacggcggccacggcccctntatgataatagtatctaggactntaacgacgccctcgaggtactcccgtaggacgtccggtatttccgtccgttcgggacccttcccgaaggcccgaccggtaacggggaaaccctaacgttcggtaccaaacgtactttacgaaccctactacgttaagttggggtaactttccgaacggttccccgtaggaacgggtaaccggagggtacttacggggtaaactttacgtttaaccgtggttaacccagttacccgaaaggttaaccgaacccggtacccccaaaccctaaccttaaccggtaacccaccgggtttaccggcccgggttaccggggacggggtaaaccggacccgaaacgttccggtaaccggttaccccgtttccgttacgggaccaccggtaaccccgttaacgggtcccccg

SEQ ID NO: 437751 - DNA, 594 bp, Homo sapiens
  misc_feature: GZ8MTXP01ELM8N.25.62.F07.1.454.CMB.2.raw
  modified_base (241)..(241): a, c, t, g, unknown or other
  modified_base (325)..(325): a, c, t, g, unknown or other
  modified_base (369)..(369): a, c, t, g, unknown or other
  modified_base (575)..(575): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgctttgccaacacaatatggttactggtacagcagaaggcgggccacggcccctctatgataatatatctggacttctaagnggccctgagggactcccgtgacgcgtatttctctcggtctccgnggcgcgaaggggactaaacgtgtacactacttacgacctatactagttcgggacgttccaggtcccgtaggacgggacggtaagggtccctaggggtaactttagttaacctgtaccagtcgaggtacgaccgccaacctacgtactccgacgttcggtcggttcgggcgggaacgaccgttagctaaccggtcgtcgttcggacncggtcccgaacggtccccg

SEQ ID NO: 437752 - DNA, 588 bp, Homo sapiens
  misc_feature: GZ8MTXP01AHZDM.25.62.F07.1.454.CMB.2.raw
  modified_base (279)..(279): a, c, t, g, unknown or other
  modified_base (371)..(371): a, c, t, g, unknown or other
tcagactgtacagtcacgaccggtgctcgatttagtagtcgcataaagggaaagggggggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctcgtggagatgtctttgacctaacacaatagtgttactggtaccagcagaaggcggcacggcccctnatgataatatatctggactcgtaagacggcctagagggactcccgtgagcgtattctcgtggctcgacgccgcgagggacaactgtacacgnttcgaccatcagttggacttcccagcctaggacgacgacggctacgacttatacgtgtactagtaccgaggtacgggccaccaacctaactaacctcgacgtcggtcgtcgggacgggtacggacccaaggcgtcgaccgttccttcggaccgcgttacccgaggttcccgtcccgtccccgtcggtactaccttcctccgggttaaccccgtcccc

SEQ ID NO: 437753 - DNA, 532 bp, Homo sapiens
  misc_feature: GZ8MTXP01CEMCZ.25.62.F07.1.454.CMB.2.raw
  modified_base (295)..(295): a, c, t, g, unknown or other
  modified_base (317)..(317): a, c, t, g, unknown or other
  modified_base (436)..(436): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactntaagaggcctcgaggatccctgacgcgattctctggctcaagcgcgagggacaacgtgtcactattgaccatcattgagtcagctgagacgagctgggactatactgacagtcagtacnccgtaccaccacctacgtcacgttcgcggttcggaccgggaggacccgaagccgtaacggaccgttcgttcggacgacgtaacccgaaggtccccg

SEQ ID NO: 437754 - DNA, 705 bp, Homo sapiens
  misc_feature: GZ8MTXP01BLJWA.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaacacaatatggttactggtaccagcaggaaggcggccacggcccctctattgataatatatctaggactacgtaagacgcctcgagggactcccgtgacgcgtattctctcggcctccgcggcgacgaacgggacctaacgtcgtactactacgtttacgaaccctattaccgtaagtttgggaaacgttcccgaaggtcccgtaagggaacgggaacggtaacgggtaccttacggggtaactttaacgtttaaccgtcggttaacgaacgttacgaaggttaaccggacccgaccccaaccctaacctaccgtcccgtaacggttcccggtaccgggttccggggaaccggggtaacgggaaccccgaagggttcccgttaacccggggtaacccgtttcccggtttcggggtacccaccgggtaacccccgttaacgggttccccccg

SEQ ID NO: 437755 - DNA, 769 bp, Homo sapiens
  misc_feature: GZ8MTXP01DDXO2.25.62.F07.1.454.CMB.2.raw
  modified_base (302)..(302): a, c, t, g, unknown or other
  modified_base (388)..(388): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctcccccctcctcactctctgcacagggtctgaggcctcctatgaggtgacacagccaccctcggtgtcagtcgtccccaggacagacggccaggatcacctgctctggagatgtctttgaccaacaacaatatggttactggtaccagcagaaggcggccacggcccctntatgataatatatctggactacgtaaggacggcccctgacgggtactccccgtggacgcgtatttccgtacgtcggacccttccgngccgccgtaaacggggaccaaacgttcgtacacctatttcgaacctataccgtaagtttacgggaacgttcccgaaggtccccgtagggaaaccggggtaaccggtaacgggtccttaaggggtaaccctttaagtttaaccgtacggttaacgtaacggttaccaaggttaaacccggacccgacccctaaacccaaacctttacccgtaaccggtaacccggttccggggttacccggggtttaccgggggaaaccgggggacgggggttaaaaccccgttaacggggttaccccgttaacccggggtaaccccggtttcccgggtttaccggggttaccgaacccgggttaacccccggaaacggggttcccccccgg

SEQ ID NO: 437756 - DNA, 668 bp, Homo sapiens
  misc_feature: GZ8MTXP01B7QGL.25.62.F07.1.454.CMB.2.raw
  modified_base (296)..(296): a, c, t, g, unknown or other
  modified_base (399)..(399): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctcccctctcactctctgcacagggtctgaggcctctatgaggtgacacagccaccctggtgtcagtcgtccccaggacagacggccaggatcacctgctctggagatgtctttgaccaacacaatatggttactggtaccagcagaaggcggcacggcccctntatgaataatatatctaggactactaagacggcctgagggtactccccgtgacgcgtatttcgtctaggctacccaagcgacgtagggaacctaactgaccanactttacgaacctataccgtaagtttgggacgttacccaagcccgtaaggacgggaaacgttagggaccgttagtaacgttaacgttacgtacgtacgtaacgtacgtacgtaaccgaaccgtaccctaaccctaacctaaccgtaaccgtaccggttaccggtccgggttaccggggtaccggggtaacgggttaaccggaccggttaccggtaaccggtacccgttccgttaccggtaccgttaccgtaacccgttaaccggtcccg

SEQ ID NO: 437757 - DNA, 644 bp, Homo sapiens
  misc_feature: GZ8MTXP01DLMB0.25.62.F07.1.454.CMB.2.raw
  modified_base (386)..(386): a, c, t, g, unknown or other
  modified_base (487)..(487): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccacccgtcggtgtcagtcgtccccaggacagacggccaggatcacctgctctggagatgtcttgaccaaacacaatatggttactggtaaccagcaggaacggcggccacggcccctatatagataatatatctggactacgtaaagcggcccttagacggtactcccgtagacgcgtattcctcgtggaccctccgnggccgacgaacggggacctaacgtgtacactatttcgaaccagtctagttgggactccagccgtaggacggacgacggcttacggggaactttagttaacncggtactacgtacgaagtaacggaccaccctacctaactaccgtaacgtaccggttccgggtcgttccggggaacgggtaaccgggaaccgacgttacccggtcgtaaccccggttccgtttacgggccgttacgccccggttaaacggtcccccgg

SEQ ID NO: 437758 - DNA, 627 bp, Homo sapiens
  misc_feature: GZ8MTXP01DBXNJ.25.62.F07.1.454.CMB.2.raw
  modified_base (315)..(315): a, c, t, g, unknown or other
  modified_base (397)..(397): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccacccctcggtgtcagtcgtcccaggacagacgccaggatcacctgctctggagatgtctttgaccaaacacaattagtggttactacggtaccagacgaaggaacgggccgggcccacggccccctntattagaattaatatatcgtggactacgtaaacgcggccctagacggtactcccgtgacgcgtattctcgtcggtcctccgngcgacgacgggacaactgtacactattcgaacctatacgtagttggaacgttccgacgccgtaggacggacgagtcttagggtaacttaagtttacgtgtacgagttacgagtaacgccaccaacctactccgtaaccgtcggttccgggaccggttccgggacgggaaccggaccgacgccgtcggtacccgttccgttcgggaccaccggtaaccgaacgggtccccg

SEQ ID NO: 437759 - DNA, 630 bp, Homo sapiens
  misc_feature: GZ8MTXP01BHQAV.25.62.F07.1.454.CMB.2.raw
  modified_base (300)..(300): a, c, t, g, unknown or other
  modified_base (406)..(406): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgcttgccaacacaatatggttactggtaccagcaggaaggcggccacggccccctntattgataatatatctaggactcgtaagcgtcccctagacggactcccctgacgcgtattctctggccctccgaagcgacgacgggacaacgtcgtacactagttnaccctatcagttggaacgttccaaggtcctaggacggacgaggctaggggaacttagttaccgtgttacgagttccgaaggttaacggaccacccgtaaaccctacctttaaccgccctaacgggttccggtccggtttccggggaaccgggtacgggaacccgaagggttccgtaacggtacccgttccgtttcgggaccaccggtcccgaacgggtcccccg

SEQ ID NO: 437760 - DNA, 646 bp, Homo sapiens
  misc_feature: GZ8MTXP01A3G5N.25.62.F07.1.454.CMB.2.raw
  modified_base (243)..(243): a, c, t, g, unknown or other
  modified_base (294)..(294): a, c, t, g, unknown or other
  modified_base (379)..(379): a, c, t, g, unknown or other
  modified_base (527)..(527): a, c, t, g, unknown or other
  modified_base (638)..(638): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctcgtgganatgtcttgccaacacaatatggtactgtacagcagaggcggcacggccctntatgataatatactctaggactacgtaacgacggtccctacgagggtacctccgtagacgcggtacttcgtcgtcggaccctcgnggccgacgacgggaacctaacgtgtacctaacgtatttacgaacctagtctaaggttcggacgtacccgaaggtccctagggacgggaaccgtagggtccttaggggtaacttacgttttaccaggtcgaacgttcaacgggtaaccncccgtacccaaacctaccttaccgtccgtaacggttccgggtccgggttacgggacggggaaccggacgacggttccgtaacgtaccgtcttacgggcaccggtaacccgngggtcccc

SEQ ID NO: 437761 - DNA, 520 bp, Homo sapiens
  misc_feature: GZ8MTXP01EO53Q.25.62.F07.1.454.CMB.2.raw
  modified_base (295)..(295): a, c, t, g, unknown or other
  modified_base (359)..(359): a, c, t, g, unknown or other
  modified_base (463)..(463): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagaggccctcagggatcccgtgacgcgattctctggctccngcgacgagggacaactgtcacattgaccatcattggactccagcctgagcgaggcctgggaacttattacctgtacagtctagtacgacgccaccactctaacncgttcgcgttcggcggaggaccgagcgtgaccgtcgttggcacgcccgaacggtccg

SEQ ID NO: 437762 - DNA, 728 bp, Homo sapiens
  misc_feature: GZ8MTXP01B3SOH.25.62.F07.1.454.CMB.2.raw
  modified_base (240)..(240): a, c, t, g, unknown or other
  modified_base (255)..(255): a, c, t, g, unknown or other
  modified_base (269)..(269): a, c, t, g, unknown or other
  modified_base (294)..(294): a, c, t, g, unknown or other
  modified_base (325)..(325): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgctttgaccaaanacaatatggttacnggtaccagcagagcggcagcccctntatgataatatatctggactctaagcgcctnagggactcccgtgaacgcgtattcctctggcctccaaggccgacgaaggggacctaaacgtcgtaccaaactagtttacgaaccctaaatcctaaagtttcgggaaacggttcccaaggtaccccgttagggaacggtaacgggaaacgggtccttacgggggtaaacccttttaaagtttaaacccgttcgggtttaccaaacgggtttcccgaaaggtttaacccggaaccggtaccccaaaccctaaaccccgttaaccttaaccgaaacccggtttcgggcccggttttaccggggaaccgggggttaacgggaaccccgttaaaggacccgttaacgggtaaccccggttccgtttacgggggtaccaaccgggaaccccgttaaacggggtcccccg

SEQ ID NO: 437763 - DNA, 543 bp, Homo sapiens
  misc_feature: GZ8MTXP01DCHL3.25.62.F07.1.454.CMB.2.raw
  modified_base (299)..(299): a, c, t, g, unknown or other
  modified_base (415)..(415): a, c, t, g, unknown or other
  modified_base (449)..(449): a, c, t, g, unknown or other
  modified_base (465)..(465): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgtctttgaccaacacaatatggttactgtaccagcagaaggcggcacggcccctntatgatatatatctgactctaagcggccctgaggactcccgtgacgcgtattctctggcctccaagcgacgacgggacaactgtacaacatttcgaccagtcagttggacgttccngcctagacggacgaggctagggtactaagttacnggtaccagtcagtacnccgaccaacactctcgacgttcggacgttcggacggacgggacagctgacccgttcgtggccacgtcccgaagtcccg

SEQ ID NO: 437764 - DNA, 771 bp, Homo sapiens
  misc_feature: GZ8MTXP01A4Y0Q.25.62.F07.1.454.CMB.2.raw
  modified_base (301)..(301): a, c, t, g, unknown or other
  modified_base (383)..(383): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacacgccaccctcggtgtcagtcgtccccaggacagacggccaggatcacctgctctggagatgtctttgaccaacacaatatggttactggtaccagcagaacggcggccaggcccctntattgataatatatctaggactacgtaagacggccctgagggactcccgtgacgtcggtattcgtacgtcggtccctaccgnggtccgacgaaacggggaacctaaacgttcgggtacctaactactttacggaaccctacttacctaagtttacggggtaaccgttacccgaaacggtccccgttagggaacgggaccgggaagggtacccgttagggggtaaacctttaacgttaaccgtacggttaccgtaacggtaccgtaaagggttaaccgaacccggtacccctaaaccctaacccgttaacccgttaacccggtaacccgggtttcccgggtaccgggttttacccggggacccgggggtaacgggttaaccccgttaacggttcccggttaacccgggtaacccggtttcccgttttacggggccgttaacccggaaccccggttaacggggttcccccgg

SEQ ID NO: 437765 - DNA, 684 bp, Homo sapiens
  misc_feature: GZ8MTXP01EYM2U.25.62.F07.1.454.CMB.2.raw
  modified_base (308)..(308): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctggtgtcagtcgtccccaggacaggacggccaggatccacctgctcgtggagatgtctttcgaccaaacacaattagtcggttactggtaccagcgaagacggcggcacggcccctntatgataatatatctaggactactaagcgccctgagggtactccgtagacgcgtattctcgtacggcctacgaagcgacgacgggtacaacgttgtacccatatttcgaaccctattaccgtaagttggggaccttacccgaagtcccgaggacgggaacgtttaacgggcctaggggaaccttttaaattaccgggttagtacgtacgtacgtaacgtaacgtaccgtaaccctaaccgtaccgtaccgtaaccgtaccggttaccgggttaccgggttacggggtacgggaacgggaaccggttacggttaccgtaaccggtaccggttaaccggttccggtaccgttaccggtaaccggttaaccggtaaccg

SEQ ID NO: 437766 - DNA, 667 bp, Homo sapiens
  misc_feature: GZ8MTXP01BXCQC.25.62.F07.1.454.CMB.2.raw
  modified_base (567)..(567): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacacgccaccctcggtgtcagtcgtcccaggacagacggccaggatcacctgctctggagatgtctttgaccaaacactaaatagttaggttactggtacccagacgaggaacggcgggccacggtcccctcgtatagataatatatcgtaggactacgtaacggacgtccctgacgggtactccccgtggaccgacgtactttccgtcgttcggccctaccgaacggccgaccgaacggggtaacctaaccgttcgtacaactacgttcaacctagtctagtttacgggaacgtacccgtaagcccgtaggacgggtaccggaagtccgttacgggtaacgtttaaattaccgtggtacctaacgttcgaaacgttacggacccnccctaaccctataccctcgacggttccgcgggttacggacggggtcgaaccgagttccgtaacggtccctccgttggaccgaccgtccgttaacggcccg

SEQ ID NO: 437767 - DNA, 592 bp, Homo sapiens
  misc_feature: GZ8MTXP01E2GZN.25.62.F07.1.454.CMB.2.raw
  modified_base (241)..(241): a, c, t, g, unknown or other
  modified_base (300)..(300): a, c, t, g, unknown or other
  modified_base (363)..(363): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctgganatgctttgaccaacacaatatggttactggtaccagcagaaggcggaccacggcccctntatgaataatatatctaggactactaaggacggccctacgaggactccgtgacgcgtattctntcggcctccaagccgagacgggactaactgtacactacttacgaccatctagttgacgtccgtacgcctggacggacgaggcctaggtacttaattactgtacgtaacgtccaaggtacgaccgtacccaacctaacctactccgaacggttcggccggttcgggacgggtacggaaccgttacggcgtcgtacccgttccgtcggtacgaccgcccgaacggtccccg

SEQ ID NO: 437768 - DNA, 685 bp, Homo sapiens
  misc_feature: GZ8MTXP01DF479.25.62.F07.1.454.CMB.2.raw
  modified_base (244)..(244): a, c, t, g, unknown or other
  modified_base (420)..(420): a, c, t, g, unknown or other
  modified_base (567)..(567): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccacccgtcggtgtcagtcgtccccaggacagacggccaggactcacctgctctgganatgtcttgaccaacaacaatagtggttactaggtacagacaaggacgggaccgggccgaccggtcccctactattagaattaatagtacttcgtaggtacttacgtaaacggaccggacccctacggaacgggtacctcccgtagaaccgtctacgttcctcgtcggtccctccgnggccgacgacgggtaacctaacgtcgtaccactacgttacgaacctagtcgtagtttacgggaacgtacccgagtccgagggacggacggaacggtctagggtaaacctttaggttaacctggtactagtacgtacgtacggacccncctaaccaccttacgtaaccgtacggttcgggtcccgttcggggaacggtacggaaaccgttgttcggtccgtaaccggttccgttagggccgaccgttaacccgaacgggttccccg

SEQ ID NO: 437769 - DNA, 724 bp, Homo sapiens
  misc_feature: GZ8MTXP01DUXCZ.25.62.F07.1.454.CMB.2.raw
  modified_base (416)..(416): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagcccaccctcggtgtcagtcgtccccaggacaggacggccaggatcacctgctcgtggagatgtctttgaccaaacactaatagtggttaactggtaaccaggccgaaggaacgggccggggaccacgggtccccccttataattggaattaaatatatctaggacctacgtaaaggcggtcccctgacgggtactccccgtgagcgtattcgtcgtggctccgagcccgacgaagggacaactgtacactnttcgacctatctagttgggactccgagtccgtggaggacgaggtctaggtacttattacgtcgttacgagtacgtaacgttacgggaacccgaccctaaccctaaccttacccgttccgaacccggttccggtaccgggttcccggggacggggtaacggtaccgttaccgaaacggttccgttaccggttaaccccgtttccgttaccgggtcccgaaccggttaccccgttaaccgggttcccgtccccggttccccccggttcgggttcccttaacccgtttccccgtttcccgggtttcccccg

SEQ ID NO: 437770 - DNA, 725 bp, Homo sapiens
  misc_feature: GZ8MTXP01BDTVH.25.62.F07.1.454.CMB.2.raw
  modified_base (305)..(305): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgaccaacacaatagtaggttactggtaccagacgaggaaggcggccacggccccctntattgataatatatctaggacttcgtaaagcggtcccctacgacgggtactcccgtggaccgtcgtactttcctcgtcggcccttccgaaggccgacgaacggggaacctaacgttcgtacaactattacgacctattcagtttggaacgttccgaacgccgtagggacggaacggaggtcgttacgggtaactttaacgtttaaccgtggtaacgtaacggttactaaacgggttaaccggaacccgtcccctaaacccgtaaccctttaccgaacccggtaacccggttccgggtcccgggttaccgggggaccggggtaacccggggttaaccccgaaggttcccggtaaccgggttccccggttaacccggtttcgggaccgttacccgggtaacccccgaaggggttccccccgg

SEQ ID NO: 437771 - DNA, 697 bp, Homo sapiens
  misc_feature: GZ8MTXP01EHT4W.25.62.F07.1.454.CMB.2.raw
  modified_base (649)..(649): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacacgcccacccgtcggtgtcagtcgtccccgaggacagacggccaggatccacctgctcgtggagtatcgtctttacgaccaaacaactaattagttggttactggtaccagcaaggaacgggccggccacggtcccctatattagaataatatatcgtagactagtaacgacggtccctagaacggtctacccgtgaccgcgtatttccgcgtacggccctcgcggcgacgaaacgggacctaacgtcgtacctacgtagtttacgaaccctataccgtagttcggtaaaccgttccgaacgtccgtagggaacggacggtacgggtacttacggggttaaacttagttaaccgtcgtacgtacgtacgaaggttacccgaacccgtacccctaaacctaaccgttccgtaaacccgtcggttccggggttcccggttaccggggacgggtaaccggacgttacncggtaacccgtccgttaacgtcggtaccaccgtcccgaacggtccccg

SEQ ID NO: 437772 - DNA, 832 bp, Homo sapiens
  misc_feature: GZ8MTXP01ADEGL.25.62.F07.1.454.CMB.2.raw
  modified_base (247)..(247): a, c, t, g, unknown or other
tcagactgtacagtcacgaccggtgctcgatttagtagtcgcataaagggaaagggggggggagcctagctgtgctgtgggtccaggaggcagaactctgggtgtctcaccatggcctgggtccctctacttcctccccctcctcactctctgcacagggtctgaggcctcctatgaggtgacacacgcccacccgtcggtgtcagtcgtccccaggacagacggccaggactcactgctcgtgganatgtcttcgaccaacactaatattaggttactggtaaccaggacgaggaacgggccggtaccgaaccggtcccctattagttagaaattaatattatcgtacggaaccttacgtaaacgggaccggtccccgtacgaacgggggtaccttaccccgtaggtaaccgtcggttactttccgttacggtccgggtaacccttaccggaacggacccgaacgggaaacgggtaaaccctaacgttcgtaaccacgttacgttaccgaaccctattaccgtaggtttaccggggaacctaccggacggtaccggtaagggaccgggtaaccggtacggttaccgttaacggttaacgtttacgttacggtacgttaaccgacggttaccgtaaacggtaacccgacccgtaaccccttaacccgtaccttacccggtccggtaacccggggtttccgggtacccgggggttaacccgggggaaccgggtaaaccgggttacccgttacgggttccccggttaaacccgggttcccggtttccgggtaccggtacccggttacccggtaacccggttaacccggtccccg

SEQ ID NO: 437773 - DNA, 624 bp, Homo sapiens
  misc_feature: GZ8MTXP01AM728.25.62.F07.1.454.CMB.2.raw
  modified_base (581)..(581): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacgccaggatcacctgctctggagatgtctttcgaccaacacaattatggttactggtaccagcgaaggacggcgggaccacggcccctactatgataatatatcgtagactacgtaagacggaccctgaggtactcccgtagacgtcgtacttctcgtcggcctccgaagccggacgacgggaccaactgtacactagtttacaaccctaatctaagtttcggacgttccgaacgccgtagggaacggtaccggaggtctcgggtaacctttaatttacgtcgtaccgaagttccgaagtacgaccgtacccacctacttaccgcctacgttccgggtaccgttcgggaccgggaggacccgngccgtcggtacccgtcgttcggaccacggtcccgaaggtcccc

SEQ ID NO: 437774 - DNA, 745 bp, Homo sapiens
  misc_feature: GZ8MTXP01AU8KR.25.62.F07.1.454.CMB.2.raw
  modified_base (306)..(306): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctaccttctccccctcctcactctctgcacagggtctgaggcctcctatgaggtgacacagcccaccctcggtgtcagtcgtccccaggacagacggccaggactcacctgctcgtggagatgtctttgaccaacacaattatggttactcggtaccagcaggacggccggccacgccctntatgataatatatctaggactacaagcgtcctgacggtactcccgtgacgtcgtacttcgtcgtcggcctaccgcgcgacgtacggggaaccctacgtcgtacacctattcggaaccctagttacctaaggttacggaaccgttaccggacggtaaccggttacgggaacgggtacggtacgggtacgttacggggttacctttaacgtttacgtacggttaaccgttacggtaccgtaccggtaaacccgtacccgtaacccctaacccctaaccgttaccgtaaccccgtaaccgggttcccgggtacccgggttccgggggaaccgggggtaacccggaacccgttaacgggttccccgttaaccgggtaaccccggtttccccggttacgggtaccccggttacggtaacccccggaaacgggtttccccccggg

SEQ ID NO: 437775 - DNA, 708 bp, Homo sapiens
  misc_feature: GZ8MTXP01B2VQZ.25.62.F07.1.454.CMB.2.raw
  modified_base (242)..(242): a, c, t, g, unknown or other
  modified_base (303)..(303): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctgganatgtctttgaccaaacacaatatggttactggtaccagcagaacggcggccacggcccctntatgataatatatctaggactacaagcgcctagaggtactccgtgacgcgtattctcgtggcctcgaacgcgacgacgggtacaacgtcgtacactattacgacctatcgtaagttggaacgtccgaagtcccgtggaacgaccggtaggtacccgttaggggtaacctttagttaaccgtggttaccgtaacgttacgaacgggttaaccggaaccccgtacccaaacccctaaccgttaaccttaacccggtaacccggttcccgggggttacccgggtttccgggggaaacccgggggtaaccgggttaacccgaaacgggttcccgttaaacgggtaccccggtttccggtttaccgggacccgttaacccgggtaaccccgttaaaggggttcccccccg

SEQ ID NO: 437776 - DNA, 626 bp, Homo sapiens
  misc_feature: GZ8MTXP01AJOW4.25.62.F07.1.454.CMB.2.raw
  modified_base (242)..(242): a, c, t, g, unknown or other
  modified_base (385)..(385): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacgccaggatcacctgctctgganatgtctttgaccaaacactaatagtggttactggtaccagcgaggaacgggccggaccacggcccctctattgaattaatatatctaggactactaagacgccctgacggtctcccgtgacgcgtattcgtcgtggcctccgngcgcgaagggaactacgtcgtacactatacgacctatctagttggacgttaccgagtccgtaggacggacgaggtcctaggggtaaccttaagtttctacgtacgtacgtactaggtaacgaccgtacccaaacctactactccgtaacgttccggtcggttaccggacgggaaccggaaccgttacgccgttaacggacccgttccgttacggtccgacgccccgttaaagggtcccccg

SEQ ID NO: 437777 - DNA, 798 bp, Homo sapiens
  misc_feature: GZ8MTXP01B5PQS.25.62.F07.1.454.CMB.2.raw
  modified_base (288)..(288): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtcgtccccaggacaggacggccaggatcacctgctcgtggagatgtctttgacctaaacactaatagtggttactggtaccagcaaggaggccggccacggcccctnatagaataatatatcgtaggactagtaaaggacggtcccctaggagggtacctcccgtaggacgtcgtatttccgtcgtcggtcctaccgagcccccggacggaacggggaacctaaacgtcggttaaccaactaacgtttacgaaaccctattaccgtaggtttacgggacgttacccgtaacggacccgttaaggggaaccggggtaaccggaacggggttactaacggttaacctttaaggttacctagggtacctaggtaacgttaacggtacggggaacccctacccgtaaccctaacctaacttcccggaaccggttccggtaccggggttccggggaaaccgggaccgggaacccgaaaggtcccgttaaaccgggccccgttttaccggttcgggtaacccgaaccgggttaccccgaacggggttccccttccccgggtccccccggttcgggttaacccctccccgtttcccgtttcccccgggttcccccgttcccccc

SEQ ID NO: 437778 - DNA, 612 bp, Homo sapiens
  misc_feature: GZ8MTXP01DMD6I.25.62.F07.1.454.CMB.2.raw
  modified_base (240)..(240): a, c, t, g, unknown or other
  modified_base (294)..(294): a, c, t, g, unknown or other
  modified_base (330)..(330): a, c, t, g, unknown or other
  modified_base (484)..(484): a, c, t, g, unknown or other
  modified_base (523)..(523): a, c, t, g, unknown or other
  modified_base (592)..(592): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgccaacacaatatggtactgtaccagcagaaggcggccaggcccctntattgataatatatctaggactactaagacgccctnagggactccctgacgcgtattctcgtggacctccgaacgcgacgaggggaaccaactgtcaacattcacctatacattggggaacttcccgaagcccgaggaacgggaccgtaagggcccttaaggggaacctttaagtttaacctggttaccnggtacaggttaaagacccgacccttaacccaaccttacncgtaacggttcgtcggttcgggaccgggtacgggaaccaacggctaacggacccgttccgttcgggacncggtaacccgaagggtcccg

SEQ ID NO: 437779 - DNA, 501 bp, Homo sapiens
  misc_feature: GZ8MTXP02JB4DQ.25.62.F07.1.454.CMB.2.raw
  modified_base (357)..(357): a, c, t, g, unknown or other
  modified_base (434)..(434): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatccctgacgcgattctctggctcngcgcagggacaactgtcacattgaccatcattggatccagcctgagcgaggctgactatactgtcagtcagtagacnccacactactacacgtcgcgttcggcggacgggaccagcgtgaccgtcgttcggcacgccaaggccc

SEQ ID NO: 437780 - DNA, 496 bp, Homo sapiens
  misc_feature: GZ8MTXP02GWQHE.25.62.F07.1.454.CMB.2.raw
  modified_base (249)..(249): a, c, t, g, unknown or other
  modified_base (292)..(292): a, c, t, g, unknown or other
  modified_base (326)..(326): a, c, t, g, unknown or other
  modified_base (355)..(355): a, c, t, g, unknown or other
  modified_base (416)..(416): a, c, t, g, unknown or other
  modified_base (469)..(469): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaanacaatatggttactggtaccagcagaaggcggccaggcccctntattgataatatatctggactctaagaggccctnagggatccctgacgcgattctctggctcngcgcagggacaactgtcacattgaccatcattgagtccagctgagcgaggctgactatacngtcagtcagtagacgccacactactcacgtcgcgtcggcggacggaccaagcngaccgtcttacggcacgcccgaaggcc

SEQ ID NO: 437781 - DNA, 495 bp, Homo sapiens
  misc_feature: GZ8MTXP02F49HJ.25.62.F07.1.454.CMB.2.raw
  modified_base (353)..(353): a, c, t, g, unknown or other
tcagactgtacagtcacgaccggtgctcgatttagtagtcgcataaagggaaaggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatccctgagcgattctctggctcngcgcagggacaactgtcacattgaccatcattgatccagcctgagcgaggctgactatactgcagtcagtagacgccaacactactcacgtcgcgttcggcggacgggaccaagctgaccgtccttaggcacgcccaaggcc

SEQ ID NO: 437782 - DNA, 502 bp, Homo sapiens
  misc_feature: GZ8MTXP02GVEDZ.25.62.F07.1.454.CMB.2.raw
  modified_base (326)..(326): a, c, t, g, unknown or other
  modified_base (355)..(355): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctnagggatccctgacgcgattctctgcctcngcgcagggacaactgtcacattcgaccatcattgacgtccagcctgacgacgaggctgactattactgtcagtcagtagacgccacactactcacgtcgcgtcggcggtacggaccagctgacccgtcgttggcacgccgaagtccg

SEQ ID NO: 437783 - DNA, 510 bp, Homo sapiens
  misc_feature: GZ8MTXP02FLJVH.25.62.F07.1.454.CMB.2.raw
  modified_base (358)..(358): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggtactggtaccagcagaaggcgggccaggcccctctattgataatatatctggactctaagaggccctcagggatccctgacgcgatctctggctccngcgcagggacaactgtcacattgacccatcattggagtccaagcctgagcgaggctgactatactgcagtcagtagcgacctaccactaactcacgtcgacgttcggacggacgggaccaagctgacccgtcctggtcaggacccaggtccc

SEQ ID NO: 437784 - DNA, 516 bp, Homo sapiens
  misc_feature: GZ8MTXP02H5P8O.25.62.F07.1.454.CMB.2.raw
  modified_base (359)..(359): a, c, t, g, unknown or other
  modified_base (447)..(447): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcaggggactccctgacgcgattctctggctccngcgcaggggacaactgtacacattgaccctatcattggagtccagcctagaggacgaggctgacttattactgtacagtcagtagacnccacactactcacgtcgcgttcggcggacgggaccaagctaacgaccgtcttcggcacgccaacggccc

SEQ ID NO: 437785 - DNA, 541 bp, Homo sapiens
  misc_feature: GZ8MTXP02I24TB.25.62.F07.1.454.CMB.2.raw
  modified_base (293)..(293): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcacggcccctntattgataatatatctggactctaagaggtcctcagggatcccgtgacgcgtattctctggctcagcgcgaaggggtaccaacgtgtcaactattcgaccctatcagttggaacgtccaagccctaggacgggacgaagggctacggacttattacctgtaccagttcaaggtacgacgacccacactactcgacgtcgcgtcggacggacggaccagctgaccgtcttaggcacgccgaacggtccg

SEQ ID NO: 437786 - DNA, 512 bp, Homo sapiens
  misc_feature: GZ8MTXP02FYBRR.25.62.F07.1.454.CMB.2.raw
  modified_base (294)..(294): a, c, t, g, unknown or other
  modified_base (362)..(362): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctntattgataatatatctggactctaaagacggccctcgagggatccccgtgacgcgattctctggctcngcgcagggacaacgtgtcacattgacccatcattgatccagcctgagacgaggctgactattactgtacagtcagtagacgccacactactcacgtcgcgttcggcgacgggaccaagctcgtaccgtctcggtacacgccgaaggcccg

SEQ ID NO: 437787 - DNA, 501 bp, Homo sapiens
  misc_feature: GZ8MTXP02GAVIR.25.62.F07.1.454.CMB.2.raw
  modified_base (292)..(292): a, c, t, g, unknown or other
  modified_base (347)..(347): a, c, t, g, unknown or other
  modified_base (356)..(356): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagcggccctcagggatcccctgacgcgattcnctggctccngcgcagggacaatgtcacattgaccatcattggatccagcctgagcgaggctgactattactgtcagtcagtagacgccacactactcacgtcgcgttcggcggacgggaccaagctaagaccgtcttcggcacgcccaaggccc

SEQ ID NO: 437788 - DNA, 508 bp, Homo sapiens
  misc_feature: GZ8MTXP02J0Q5Q.25.62.F07.1.454.CMB.2.raw
  modified_base (295)..(295): a, c, t, g, unknown or other
  modified_base (330)..(330): a, c, t, g, unknown or other
  modified_base (363)..(363): a, c, t, g, unknown or other
  modified_base (444)..(444): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgcaaacacaatatggttactggtaccagcagaaggcggccaggcccctntattgataatatatctggactctaagacggccctnaggggactcccgtgacgcgattctctggctccngcgcagggacaactgtacacattgaccatcattggatccagcctgagacgaggctgactattactgtacagtcagtagacnccacactactcacgtcgcgttcggcggacgggaccaagctgaccgtctcggtcacgcccaggcc

SEQ ID NO: 437789 - DNA, 508 bp, Homo sapiens
  misc_feature: GZ8MTXP02GOQH0.25.62.F07.1.454.CMB.2.raw
  modified_base (328)..(328): a, c, t, g, unknown or other
  modified_base (358)..(358): a, c, t, g, unknown or other
  modified_base (412)..(412): a, c, t, g, unknown or other
  modified_base (424)..(424): a, c, t, g, unknown or other
tcagactgtacagtcacgaccggtgctcgatttagtagtcgcataaagggaaagggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctctattgataatatatctggactctaagaggccctcaggggatccctgagcgattcnctggctccagccgcagggacaactgtcacnttgaccatcattggatccagctgagacgaggctgactattactgtcatcagtanacgcacactacncacgtcgcgttcggcggagggaccaaggctgaccgtcctggtcacgcccaaggcctgccccctggtcacctctcgttcccaccc

SEQ ID NO: 437790 - DNA, 584 bp, Homo sapiens
  misc_feature: GZ8MTXP02FT0YY.25.62.F07.1.454.CMB.2.raw
  modified_base (238)..(238): a, c, t, g, unknown or other
  modified_base (295)..(295): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctgganatgctttgccaacacaatatggttaactggtaccagcagaaggcggccaggcccctntattgataatatatctggactctaaagagccctcagggatacccgtgacgcgattctctggcttccagcgctaaggggaccaacttgcacactttgaacccatcaatttggggaaccgccacgcgtaggacggacgtaggctagtaacttagttacgtacgtactacgtacgacgtacgacgacccaacctactactacgaccggtcggtccggttacgggacggaacggaaccgaagccgtaaccggtacccgttaccgttcggtaccgacggtacccgaacggtccg

SEQ ID NO: 437791 - DNA, 530 bp, Homo sapiens
  misc_feature: GZ8MTXP02GQP27.25.62.F07.1.454.CMB.2.raw
  modified_base (463)..(463): a, c, t, g, unknown or other
  modified_base (499)..(499): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctctatgataatatatctggactctaagacgccctcgagggactcccgtgacgcgtattctctggcctcgagcgcgagggacaacgtgtcacattcgaaccatcagttggacgtccagcctggacggacgaggctagacttattactgtaccagtcagtagacgccaaccnctaactcgacgtcgcgttcggcggacggaccaagcncgaccgtcgttcggcacgcccgaaggtcccg

SEQ ID NO: 437792 - DNA, 515 bp, Homo sapiens
  misc_feature: GZ8MTXP02HUQXJ.25.62.F07.1.454.CMB.2.raw
  modified_base (293)..(293): a, c, t, g, unknown or other
  modified_base (327)..(327): a, c, t, g, unknown or other
  modified_base (358)..(358): a, c, t, g, unknown or other
  modified_base (402)..(402): a, c, t, g, unknown or other
  modified_base (413)..(413): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctnagggactccctgacgcgattctctggcctcngcgcagggacaactgtacacattcgaccatcattgatccagccngagacgaggcngacttagtactgtcagtcagtagacgccacactactcacgttcgcgttcgggcgacgggacccaaggcctaaggacccgtcttcggcacgcccaacggtccc

SEQ ID NO: 437793 - DNA, 507 bp, Homo sapiens
  misc_feature: GZ8MTXP02IH9UB.25.62.F07.1.454.CMB.2.raw
  modified_base (357)..(357): a, c, t, g, unknown or other
  modified_base (420)..(420): a, c, t, g, unknown or other
  modified_base (436)..(436): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttcctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctgactctaagaggccctcagggatccctgacgcgattctctggctccngcgcacgggacactgtcacattgaccatcattgatccagcctagagacgagctgactattacngtacagtcagtagacncaaccactactcacgtcgcgttcggacgacggaccaagctcgaccgtcgttcggacacgacccgaaggccc

SEQ ID NO: 437794 - DNA, 548 bp, Homo sapiens
  misc_feature: GZ8MTXP02G0DE5.25.62.F07.1.454.CMB.2.raw
  modified_base (519)..(519): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcaggggactcccgtgacgcgattctctggctcagcgcgagggaccaactgtacactattcgaaccctatcaagtttgggaacttcccgaagtcccgtaggacggaccggaagggtcctaggaccttagttacctggttacagtcagtagacgaccaacactactcacgtcgcgttcggacggacggacaagcncgtaccctcgttcgcacgccgaagtcccg

SEQ ID NO: 437795 - DNA, 555 bp, Homo sapiens
  misc_feature: GZ8MTXP02FV95U.25.62.F07.1.454.CMB.2.raw
  modified_base (294)..(294): a, c, t, g, unknown or other
  modified_base (327)..(327): a, c, t, g, unknown or other
  modified_base (358)..(358): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagagccctnagggatccctgacgcgtattctctggctccngcgcagggacaactgtcactattcgaccctatcaagtttggaagtcccaagcccgtggaacgggaccgaagggtcctaggaaccttatttaacctggttaccagttccaagtacgaccgacccaaccactaacctcacgtcgtcggttcggcgggacgggaccaagctgaccgtcgttcggcacgcccgaaggtccg

SEQ ID NO: 437796 - DNA, 504 bp, Homo sapiens
  misc_feature: GZ8MTXP02HTS3I.25.62.F07.1.454.CMB.2.raw
  modified_base (326)..(326): a, c, t, g, unknown or other
  modified_base (348)..(348): a, c, t, g, unknown or other
  modified_base (357)..(357): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctnaggggatccctgacgcgattcnctggcctcngcgcagggacaaactgtcacattgaccatcattggatccagcctgagacgaggctgacttattactgtcagtcagtagacgccaccactactcacgtcgcgttcgggcgacgggaccaagctgaccgtcttggcacgcccaaggccc

SEQ ID NO: 437797 - DNA, 522 bp, Homo sapiens
  misc_feature: GZ8MTXP02G7HKM.25.62.F07.1.454.CMB.2.raw
  modified_base (294)..(294): a, c, t, g, unknown or other
  modified_base (359)..(359): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagcggccctcagggatccctgacgcgattctctggctccgngcgcaggggacaactgtcacattgacccatcattggagtccagcctggacggagaggctagacttattactgtacagtcagtagacgccaccgactactcacgtcgcgttcggcggacgggaccagtcgtcgtaccgtccgttggtaccacgcccaaggcccg

SEQ ID NO: 437798 - DNA, 492 bp, Homo sapiens
  misc_feature: GZ8MTXP02F93D2.25.62.F07.1.454.CMB.2.raw
  modified_base (293)..(293): a, c, t, g, unknown or other
  modified_base (320)..(320): a, c, t, g, unknown or other
  modified_base (327)..(327): a, c, t, g, unknown or other
  modified_base (355)..(355): a, c, t, g, unknown or other
  modified_base (358)..(358): a, c, t, g, unknown or other
  modified_base (450)..(450): a, c, t, g, unknown or other
  modified_base (470)..(470): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagnggccctnagggatccctgacgcgattctctgctcngcncagggacaactgtcacatgaccatcattgatccagcctgacgacgaggctgacttatactgtcagtcagtagacgcaacactactcacgtcncgtcggcggacggaccagcngaccgtctgtcacgccagtccg

SEQ ID NO: 437799 - DNA, 511 bp, Homo sapiens
  misc_feature: GZ8MTXP02F0MV7.25.62.F07.1.454.CMB.2.raw
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagagccctcagggatccctgacgcgattctctggcctcagcgcagggacaacgtgtacacattgaccatcattgagtccagcctgagacgaggctgactattactgtcagtcagtacgacgccaaccactactcacgtcgcgttcggcggacggaccaagctggacccgtcgttcggtcacgcccaaggtcccg

SEQ ID NO: 437800 - DNA, 527 bp, Homo sapiens
  misc_feature: GZ8MTXP02GOH8W.25.62.F07.1.454.CMB.2.raw
  modified_base (264)..(264): a, c, t, g, unknown or other
  modified_base (293)..(293): a, c, t, g, unknown or other
  modified_base (327)..(327): a, c, t, g, unknown or other
  modified_base (431)..(431): a, c, t, g, unknown or other
  modified_base (443)..(443): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttacnggtaccagcagaaggcggccaggcccctntattgataatatatctggactctaagaggccctnagggatccctgacgtcgtttctcgtcggctccagccgcaggggaccaactgtacacattgaccatcaagttggagtcagcctgaggacgaggctgactattacngtcagtcagtancgaccaccactactcacgtcgcgttcggacggacgggaccaagtctacgaacccgtcttcggcacgtacccgaacggcctcccg

SEQ ID NO: 437801 - DNA, 515 bp, Homo sapiens
  misc_feature: GZ8MTXP02F798Z.25.62.F07.1.454.CMB.2.raw
  modified_base (294)..(294): a, c, t, g, unknown or other
  modified_base (350)..(350): a, c, t, g, unknown or other
  modified_base (359)..(359): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctntattgataatatatctggactctaagcggccctgagggactccctgacgcgattcnctggcctcngcgcagggacaactgtcacattgaccatcattggactccagcctgaggacgaggctgacttatactgtacagtcagtacgacgccaccactacctcacgtcgcgttcggacggacgggaccagcgcgtaccgtcgttcggcacgccgaacggtccg

SEQ ID NO: 437802 - DNA, 510 bp, Homo sapiens
  misc_feature: GZ8MTXP02HBMDU.25.62.F07.1.454.CMB.2.raw
  modified_base (293)..(293): a, c, t, g, unknown or other
  modified_base (359)..(359): a, c, t, g, unknown or other
  modified_base (450)..(450): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctcagggactccctgacgcgattctctggcctccngcgcgagggacaactgtcacattgacccatcattgatccagcctgagacgagctagactattactgtacagtcagtagacgccacactacncacgtcgcgtcggacggacggaccagcgtcgaccgtccgttcggcacgcccgaagtcccg

SEQ ID NO: 437803 - DNA, 602 bp, Homo sapiens
  misc_feature: GZ8MTXP02H00H7.25.62.F07.1.454.CMB.2.raw
  modified_base (294)..(294): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntattgataatatatctggactctaagacggcctcgaggtactcccgtgacgcgattctcgtgccttccgagccgacgacgggaccaactctacaccattcgaaacccttatacgtagtagtacgtaccgacgacgtacggacggacggacggtacgtacgtacttagttacgttacgtacgtacgtacgtacgtacgaccgacccacctaacctacctaccgtaccgtccggtccggtccgggacgggacggaccgaacgacgtaaccgtacccggtaccgttacgtaccgaccgaccgaccggtccg

SEQ ID NO: 437804 - DNA, 593 bp, Homo sapiens
  misc_feature: GZ8MTXP02IECD7.25.62.F07.1.454.CMB.2.raw
  modified_base (389)..(389): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctctattgataatatatctggactctaagacggccctcagggactccctgacgcgtattctctggcttccagcgcaggggacaacctgtcactaattnacactactagtagtacgtaccacgacgtacgacggacggacggtacgtacgtacgttacttacgtacgtacgtacgtacgtacgtacgaccgaccacctaacctacctaccgtaccgtaccggtaccggttcgggtaccgggacgggaccgaacgaccgtaaccggtaccgttaccgttacggtacgtaccgtaccgacggtcg

SEQ ID NO: 437805 - DNA, 510 bp, Homo sapiens
  misc_feature: GZ8MTXP02H3GD9.25.62.F07.1.454.CMB.2.raw
  modified_base (362)..(362): a, c, t, g, unknown or other
  modified_base (431)..(431): a, c, t, g, unknown or other
  modified_base (463)..(463): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaaagaggcctcgagggatccctgacgcgtattctcttggctcccngccgcagggacaactgtcacattgaccatcaattgacgtccagcctgaggacgaggctgacttattacngtcagtcagtagacgcacactaactcacgtcncgttcggacgacgggaccaagctgaccgtctcggtcacgccaaggcc

SEQ ID NO: 437806 - DNA, 551 bp, Homo sapiens
  misc_feature: GZ8MTXP02GK8EH.25.62.F07.1.454.CMB.2.raw
  modified_base (293)..(293): a, c, t, g, unknown or other
  modified_base (453)..(453): a, c, t, g, unknown or other
  modified_base (459)..(459): a, c, t, g, unknown or other
  modified_base (469)..(469): a, c, t, g, unknown or other
  modified_base (481)..(481): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctacagggatcccgtgacgcgattctcgtgcctcagcgcgagggacaactgtaccacaattcgaacctatacatttgggaactccaagcccgtagaacggacgaagggcctagaaccttattactgtanaacgtnaagtacgacnccaaccactacncacgtcgcgttacggcggacggaacaacgcgaacgtaccgtccgtttaggccacgaccccgaaggtcccg

SEQ ID NO: 437807 - DNA, 501 bp, Homo sapiens
  misc_feature: GZ8MTXP02GZ5CQ.25.62.F07.1.454.CMB.2.raw
  modified_base (296)..(296): a, c, t, g, unknown or other
  modified_base (332)..(332): a, c, t, g, unknown or other
  modified_base (363)..(363): a, c, t, g, unknown or other
  modified_base (366)..(366): a, c, t, g, unknown or other
  modified_base (412)..(412): a, c, t, g, unknown or other
  modified_base (437)..(437): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataaatatatctggactctaaagaggccctnagggactccctgacgcgattctctggctccngcncagggacaactgtcacatgaccatcattgatcagctgagcgaggcngactatactgtcagtcagtacgacnccaccactactcacgtcgcgttcggcgacgggaccaagctgaccgtcttcggcacgccaaggcc

SEQ ID NO: 437808 - DNA, 568 bp, Homo sapiens
  misc_feature: GZ8MTXP02GRMJM.25.62.F07.1.454.CMB.2.raw
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctggagatgctttgccaacacaatatggttactggtaccagcaggaaggcggccacggcccctctattgataatatatctggactactaagaggccctcgagggtactcccctgacgcgattctctggccttcagcgcaggggacaacgtgtacactattgacccatcattggacgtcccagtccctaggacggacggaacgggctaggaacttaagttaccttgggtacctagttacaggtacaaccgcccaacctactactcgacgtccgcggttcggacggacgggaccaacgctaacggtacccgtcgttcggaccacgacccgaagtcccg

SEQ ID NO: 437809 - DNA, 530 bp, Homo sapiens
  misc_feature: GZ8MTXP02FUVJ1.25.62.F07.1.454.CMB.2.raw
  modified_base (331)..(331): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaacggcggccaggcccctctattgataatatatctggactctaagaggccctanagggatccccgtgacgcgattctctggcctcgagcgcgagggacaactgtcacattcgaccatcattgatccagcctgagagagctgactattactgtcagtcagtagaccgaccactactactacacgtcgtacggttcgggacggacggaccaagccgtaacgacccgtcgtttcggaccacgacccgaaggtcccg

SEQ ID NO: 437810 - DNA, 532 bp, Homo sapiens
  misc_feature: GZ8MTXP02FWFR2.25.62.F07.1.454.CMB.2.raw
  modified_base (382)..(382): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatccccgtgacgcgattctctggcctccagcgcgagggacaactgtcanattgaccatcagttggacgtccagcctggacggcgagctagacttattactgtacagtcagtacgacgccaacctactaactcacgtcgcggttcgggacggacgggaccaagtccgaacgtaccgtcgttcggccacgcccgagtcccg

SEQ ID NO: 437811 - DNA, 577 bp, Homo sapiens
  misc_feature: GZ8MTXP02GQ7UU.25.62.F07.1.454.CMB.2.raw
  modified_base (270)..(270): a, c, t, g, unknown or other
  modified_base (300)..(300): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagcccaccctggtgtcagtcgtccccaggacagacggccaggatcacctgctctggagatgtctttgaccaacacaatatggttacnggtaccagcagaaggcggaccaggcccctntatgattaatatatctggactcaaagcggccctagagggctcccgtgacgcgtattctcgtggcctcgagcgacgagggaccaactgtacatatcgaccatcattgactccagcctaggacgacgaggctagacttattactgtacagtacaggtacaccgacccaccactaacctcgaaccgtccggtacgttccgggacgggaacggacccgaaggtcccgtaacggtaccccggttcctttacgggacccaacggaccccgtaacgggtccccc

SEQ ID NO: 437812 - DNA, 523 bp, Homo sapiens
  misc_feature: GZ8MTXP02J0Y3B.25.62.F07.1.454.CMB.2.raw
  modified_base (293)..(293): a, c, t, g, unknown or other
  modified_base (359)..(359): a, c, t, g, unknown or other
  modified_base (433)..(433): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagacggccctcgagggatcccgtgacgcgattctctggctcngcgcgagggacaactgtcacattgaccatctattggacgtccagtccctggacggacgaggctagactattacngtcagtcagtacgacgccaccactactcgacgtcgcgttcggacggacggaccaagctgaccgttcgttcggcacgtcccgaaggtcccg

SEQ ID NO: 437813 - DNA, 518 bp, Homo sapiens
  misc_feature: GZ8MTXP02FR7E5.25.62.F07.1.454.CMB.2.raw
  modified_base (294)..(294): a, c, t, g, unknown or other
  modified_base (356)..(356): a, c, t, g, unknown or other
  modified_base (409)..(409): a, c, t, g, unknown or other
  modified_base (423)..(423): a, c, t, g, unknown or other
  modified_base (427)..(427): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctcaggatccctgacgcattctctggctccngcgcagggaccaatgtcacattgaccatcattgatccagcctgagcgaggtcngactattactgtanaganagtacgacgaccaccactactacacgtcgtcggtcggacggacggaaccgaacgacgtaacgtaccgtacgtcgtacgacgaccgacgccg

SEQ ID NO: 437814 - DNA, 498 bp, Homo sapiens
  misc_feature: GZ8MTXP02I37I6.25.62.F07.1.454.CMB.2.raw
  modified_base (360)..(360): a, c, t, g, unknown or other
  modified_base (380)..(380): a, c, t, g, unknown or other
  modified_base (428)..(428): a, c, t, g, unknown or other
  modified_base (488)..(488): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctctattgataatatatctggactctaaagaggccctacagggatccctgacgcgattctctggctccngcgcagggacaactgtccanattgaccatcattggatccagcctgagagaggctgactatactagtcngtacagtagacgccacactactcacgtcgcgtcggcgacggacaagctgactcttcggcncgccaaggcc

SEQ ID NO: 437815 - DNA, 614 bp, Homo sapiens
  misc_feature: GZ8MTXP02JRRI0.25.62.F07.1.454.CMB.2.raw
tcagactgtacagtcacgaccggtgctcgatttagtagtcgcataaagggaaaggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtgtccccaggacagacggccaggatcacctgctctggagatgctttgcccaacacaatatggttactggtaccagcagaaggcggccaggcccctctattgataatatatctggactcgtaagacggccctacgagggactcccgtagacgtccgtatttctcttggccttaccacggccgacgtaacgggggaccaaacgttcggtaccactaaactttcggaaaccctaatccgtaaatttgggaacgttcccgacgaccccgtggagggacggaacgggccgtaggtaccgttaagttaaccttggtacctagttacgacgttaacgacgccacctacacctaccgtacgtcgtccgttcggtcgggacggacgaacgcgtcgaccgtccgtcgtcgacgaccgacgcccg

SEQ ID NO: 437816 - DNA, 496 bp, Homo sapiens
  misc_feature: GZ8MTXP02F6JZP.25.62.F07.1.454.CMB.2.raw
  modified_base (356)..(356): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaacagcagaaggcgggccaggcccctctattgataatatatctggactctaagaggccctcagggatccctgagcgattctctggctccngcgcagggacaactgtcacattgaccatcattgagtccagcctgagacgaggctgactattactgtcagtcagtagacgccacactactcacgtcgcgttcggcggaggaccagctgaccgtcttcggcacgcccaggcc

SEQ ID NO: 437817 - DNA, 609 bp, Homo sapiens
  misc_feature: GZ8MTXP02IAWFS.25.62.F07.1.454.CMB.2.raw
  modified_base (238)..(238): a, c, t, g, unknown or other
  modified_base (366)..(366): a, c, t, g, unknown or other
  modified_base (375)..(375): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccacctcggtgtcagtgtccccaggacagacggccaggatcacctgctctggagntgctttgccaaacacaatatggttactggtaccagcaaggaaggcgggccacggcccctctattgattaatatatcgtggactctaaaggacggtccctacgaagggtactcccgtgacgcgtattcncgtgcctcngcgcagggacaacgtgacacatcgacatctagttaggacgttaccagtccgtaggacggaacgacgggtctacggtaccttaagtttacgtcgttacgtacgttaccgaaggttaacgaccggtacccaacctaacttaacctacgtaaccgtcggtaccggtttccgggacgggacgggaccaacggcgtaaccggtaccgtccgttcggtacaccggaccgtaacggccccg

SEQ ID NO: 437818 - DNA, 539 bp, Homo sapiens
  misc_feature: GZ8MTXP02JQ3G4.25.62.F07.1.454.CMB.2.raw
  modified_base (277)..(277): a, c, t, g, unknown or other
  modified_base (337)..(337): a, c, t, g, unknown or other
  modified_base (369)..(369): a, c, t, g, unknown or other
  modified_base (457)..(457): a, c, t, g, unknown or other
  modified_base (507)..(507): a, c, t, g, unknown or other
tcagactgtacagtcacgaccggtgctcgatttagtagtcgcataaagggaaaggggggtccgaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttactggtaccagcagaaggcggccaggcccctntattgataatatatctggactctaaagacggcccctgagggatcccctgacgcgatttcnctggctccagccgcaggggacaactgtacacnttcgaaccatcagtttggaacgtcccaagccctaggacgggacgaggctagactaattactgtacagttcagtagacgccacactacncacgtcgcgtcggcggaggaccaagctcgaccgtcttgcacgcccaagcncgcccccgtcggtccactctccgtcccgtccc

SEQ ID NO: 437819 - DNA, 588 bp, Homo sapiens
  misc_feature: GZ8MTXP02HVPOC.25.62.F07.1.454.CMB.2.raw
  modified_base (272)..(272): a, c, t, g, unknown or other
  modified_base (301)..(301): a, c, t, g, unknown or other
  modified_base (371)..(371): a, c, t, g, unknown or other
  modified_base (572)..(572): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggactcacctgctctggagatgtctttgaccaaacacaatatggttacnggtaccagcagaaggcggccacgcccctntatgataatatatctgactactaagacggccctgaggtactccgtgacgcgtacttctcgtggcctccgngcgcaagggacctaactgtacaacattacgaccctatccaagtttcggggaacttccgaacgttcccgtaggagggaccgaagggtcctaggaactttagttactacggtcaagttcgaagtacgacccaccaaccacttaacctcgaaccgttcgcgttcggacgacgggacctaacgctaacggtccgtcgttacgganaccgaccgtacgcccg

SEQ ID NO: 437820 - DNA, 513 bp, Homo sapiens
  misc_feature: GZ8MTXP02F1TI5.25.62.F07.1.454.CMB.2.raw
  modified_base (382)..(382): a, c, t, g, unknown or other
  modified_base (446)..(446): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcaggggactccctgacgcgattctctggcctcagcgcgagggacaactgtacanattgacctatcattgagtccagcctgagcgagctgactatactgtcatcagtacacgccaaccnctaactcacgtcgcggttcggcggacggaccaagcgtgacccgtcgtggtcacgacccaaggtcccg

SEQ ID NO: 437821 - DNA, 510 bp, Homo sapiens
  misc_feature: GZ8MTXP02J0GVW.25.62.F07.1.454.CMB.2.raw
  modified_base (295)..(295): a, c, t, g, unknown or other
  modified_base (361)..(361): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagaggccctcaggggatcccgtgacgcgattctctggcctcngcgcgagggacaactgtacacattgaccatcattggagtccagccgtagaggacgaggctgactattactgtcagtcagtagacgccaccactactcacgtcgacgttcggcggacggaccaagctgaccgtctcgcacgccacggccg

SEQ ID NO: 437822 - DNA, 569 bp, Homo sapiens
  misc_feature: GZ8MTXP02J3FZI.25.62.F07.1.454.CMB.2.raw
  modified_base (294)..(294): a, c, t, g, unknown or other
  modified_base (459)..(459): a, c, t, g, unknown or other
  modified_base (528)..(528): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatttgataatatatctggactctaagaggccctgagggactccctgacgccgtattctctggcctaccgagccgacaggggacaactgtaccacattacgacccatcctaagttggacgtccaaggtcctagggacgggacgaggtcctagaccttattaccgnggttaccaggttccaaggtacggaccgcccaaacctacctactaccacggtccgcggttacggcggacncgggaaccctaagcgttacgccgtcttgccacgaccccagg

SEQ ID NO: 437823 - DNA, 764 bp, Homo sapiens
  misc_feature: GZ8MTXP02I8KQY.25.62.F07.1.454.CMB.2.raw
  modified_base (298)..(298): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctctcactctctgcacagggtctgaggcctcctatgaggtgacacagcccaccctcggtgtcagtcgtccccaggacagacggccaggatcacctgctctggagatgctttgtacaaacacaatatggttactggtaccagcagaaggcggccaggcccctntatgataatatatctggactctaaagacgccctcgagggactcccgtgacgcgtattctcgtggcctaccagccgacgaacggggaacaaacgtgtacaactacttgaaccctatcgtaagtttcgggaaacgttcccgaacgtcccgtagggaaacggggaaccggaacggggtacccttaagggtaaaccctttaaacgtttaacccgttaggggttaaccctaaaggttacccggtaaaaggttaaccggaaaccccggtaccccaaaaccccgtaaaccgttaaccctttaccgaaaaccccgggtttccgggtacccggggtttacccgggggaacccgggggtaaaccgggggtaaaaccccgtaaaacgggcccgttaaccggggtaaacccccggtttcccggttttacggggtacccgtaaaacccgggtaccccccggaaaagggttcccccccgg

SEQ ID NO: 437824 - DNA, 511 bp, Homo sapiens
  misc_feature: GZ8MTXP02JQ2RD.25.62.F07.1.454.CMB.2.raw
  modified_base (296)..(296): a, c, t, g, unknown or other
  modified_base (330)..(330): a, c, t, g, unknown or other
  modified_base (360)..(360): a, c, t, g, unknown or other
  modified_base (441)..(441): a, c, t, g, unknown or other
  modified_base (480)..(480): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntattgataatatatctggactctaagaggccctnagggatcccgtgacgcgattctctggctcngcgcagggacaactgtcacattcgaccatcattgactccagcctagaggacgaggctgacttatactgtcagtcagtgacnccacacactcacgtcgcgtcggacggacggacaagccgngacccgttcgtcggtcaacgcccgaaggtcc

SEQ ID NO: 437825 - DNA, 502 bp, Homo sapiens
  misc_feature: GZ8MTXP02JHBS6.25.62.F07.1.454.CMB.2.raw
  modified_base (358)..(358): a, c, t, g, unknown or other
  modified_base (479)..(479): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaaagaggccctcaggggactccctgacgcgattctctggctcngcgcagggacaactgtcacattgaccatcattggatccagcctgaggacgagggctggacttagttactgtcagtcagtagacgccacactactcacgtcgcgtcggcggacggaccagcngaccgtcttggcacgcccaggcc

SEQ ID NO: 437826 - DNA, 520 bp, Homo sapiens
  misc_feature: GZ8MTXP02JZJEM.25.62.F07.1.454.CMB.2.raw
  modified_base (358)..(358): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagacggccctcagggatccctgacgcgattctctggctcngcgcagggacaactgtcacattgaccatcattgagtccagcctgaggacgaggctgactatactgtcagtcagtacgacgccacactactcacgtcgacggttcggcggacggaccgaagcgtcggacccgtccgttacggtccacgacccgaagggtcccg

SEQ ID NO: 437827 - DNA, 642 bp, Homo sapiens
  misc_feature: GZ8MTXP02GWN9U.25.62.F07.1.454.CMB.2.raw
  modified_base (251)..(251): a, c, t, g, unknown or other
  modified_base (395)..(395): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaanacaatatggttactggtaccagcagaaggcggccaggcccctctatgataatatatctggactctaagaggccctcgagggactccctgacgcgattcgtctcggctccagcgcgaggggtacaacgtgtcacattcgaacctntacgattcgggataccagccgaggaggacggtaagggcctaggaaccttacttacgtggttaccaagttaccgtaggtaacgggaccgacccgtaaccgaacgtttaaccccgtacccggttacccggtccggttacccgggttaccggggaccggggtaacccgggaacccgtacggttacccgttaacccggtacccccggtttccggtttacggtacccgtaaccggaccccgtaacggtcccg

SEQ ID NO: 437828 - DNA, 557 bp, Homo sapiens
  misc_feature: GZ8MTXP02GJNZC.25.62.F07.1.454.CMB.2.raw
  modified_base (238)..(238): a, c, t, g, unknown or other
  modified_base (445)..(445): a, c, t, g, unknown or other
  modified_base (462)..(462): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctgganatgctttgccaacacaatatggttactggtaccagcaggaaggcggccacggcccctctattgataatatatctggactctaagcggcccctcgagggactccccgtgacgcgtattctcgtggcctcagccgcgagggacaacgtgtcaactattgacctatcagttgacgtcccagcctggacggacgaggcctagactattacngtcagtcagtacgaccnccacctactactcgtacgtccgtcggttacgggcgggaacgggaccaaggtccgtaacggtaccccgtcgttcggaccgacgacccgagggtccc

SEQ ID NO: 437829 - DNA, 577 bp, Homo sapiens
  misc_feature: GZ8MTXP02G2SAF.25.62.F07.1.454.CMB.2.raw
  modified_base (267)..(267): a, c, t, g, unknown or other
  modified_base (296)..(296): a, c, t, g, unknown or other
  modified_base (303)..(303): a, c, t, g, unknown or other
  modified_base (409)..(409): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctcccctcctcactctctgcacagggtctgaggcctcctatgaggtgacacagccaccctcggtgtcagtcgtccccaggacagacggccaggatcacctgctctggagatgtcttgaccaacacaatatggtacnggtaccagcagaaggcggcacggcccctntagttanaataatatatcgagactagaagacgccagaggactccgtagacgctacttctcgtcgcctcgcgcgacgaggaactatcacaactactacgacctatcagttgacnccgacgtcgtaggaacggacgagtcgtacgtacttacttacgtacgtacgtacgtacgtaacgtaacgaccgacccaacctacctactaccgtaccgtccggtcggtacgggacggacggaaccgaacgacgtaacgtaccgtaccgtacgtacgaccgaccgacgcg

SEQ ID NO: 437830 - DNA, 515 bp, Homo sapiens
  misc_feature: GZ8MTXP02IXP8O.25.62.F07.1.454.CMB.2.raw
  modified_base (363)..(363): a, c, t, g, unknown or other
  modified_base (389)..(389): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgattaatatatctggactctaagaggccctcgagggctccctgacgcgattctcgtggccttcngcgcagggacactgtcacattgaccntcattgagtccagcctgaggacgagctagacttattacctgtaccagtcagtacgacgccaacactctcgacgtcgcgtcggcgtacgggaccagctaacgaccgtcgttgccacgccaaggtccg

SEQ ID NO: 437831 - DNA, 537 bp, Homo sapiens
  misc_feature: GZ8MTXP02I1QYB.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcgagggactcccctgacgcgattctctggctcagcgcagggacaactgacacagttcgaacccatcaatttgggacgttccaagccctggacgacggaggccttaggacttattacctggtaccagtcagtacgacgccaacactactcacgtccgcgttcggcggacggacaagcgtcgacccgtcgttcggaccacgccgaagtcccg

SEQ ID NO: 437832 - DNA, 549 bp, Homo sapiens
  misc_feature: GZ8MTXP02HKRF0.25.62.F07.1.454.CMB.2.raw
  modified_base (418)..(418): a, c, t, g, unknown or other
  modified_base (423)..(423): a, c, t, g, unknown or other
tcagactgtacagtcacgaccggtgctcgatttagtagtcgcataaagggaaaggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcaggggactccctgagcgattctctggctccgagcccgcgagggacaacgtgtcacattcgaaccatcattggatccagcctgagacgaggctgactattactgtcagtnagtanacgccacactactcacgtcgacgttcggacggtacggaccaagtcgtacgacccgttcgttacggccacgcccgaacgggcctccggcccccgttcggtccaccgtccgtccgtttccccgccccg

SEQ ID NO: 437833 - DNA, 596 bp, Homo sapiens
  misc_feature: GZ8MTXP02JG9XA.25.62.F07.1.454.CMB.2.raw
  modified_base (239)..(239): a, c, t, g, unknown or other
  modified_base (365)..(365): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgctttgccaacacaatatggttactggtaccagcaggaaggcggccacggcccctctatgataatatatctaggactctaagcgcctgagggctcccgtgaacgcgtattctctcggcctccgngcgacgacggggaaccaacgtgtaccactattcgaccctatctagttggaactcccgaacgtcccgtaggaacggacggtaagggctaggtaccttattaccgtgttaccagttcaacgtacgaccgaccaactactacctcgtacgtccgtacggttcgggacgggtacggaaccgtaagccgtaacggtacccgttcgttacggaccaccggtacccgaacggtccccg

SEQ ID NO: 437834 - DNA, 519 bp, Homo sapiens
  misc_feature: GZ8MTXP02JG5G1.25.62.F07.1.454.CMB.2.raw
  modified_base (303)..(303): a, c, t, g, unknown or other
  modified_base (358)..(358): a, c, t, g, unknown or other
  modified_base (427)..(427): a, c, t, g, unknown or other
tcagactgtacagtcacgaccggtgctcgatttagtagtcgcataaagggaaaggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctattgataatatatctggactctaagnggccctcagggatcctgagcgattctctgctccagccgcagggacaactgtcacnttgaccatcattggacgtcagcctgagacgaggctgactattactgtcagtcagtagccgcacactacncacgtcgcgttcggcggaggaccaaggctcggaccgtccgtggtcacgccctaggcctcgcccccgtcggtcactccgtcgtaccctacccg

SEQ ID NO: 437835 - DNA, 662 bp, Homo sapiens
  misc_feature: GZ8MTXP02I89X8.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctctcactctctgcacagggtctgaggcctcctatgaggtgacacagccaccctcggtgtcagtcgtccccaggacagacggccaggatcacctgctctggagatgtctttgaccaaacacaatatggttactggtaccagcaggaaggcggccacggcccctatattgataatatatctaggactctaagacggccctacgagggtactcccgtggacgtcgtattcctcgtggccttccgagccgacgaacgggggacccaaacgttcggtaaccaacgtaacgttacgaaaccctaacttaccgtaagtttacgggaacgttaccccgaaacgggtcccgttaggggaacgggtaacccgggaaagggtccttaacggtaaacttaacgtttaacgtcgtaaccgtaggttacgaacggtaacgaccgacccaacctactaaccgtccgtacggtccgtacgggtacggacgggacggaaccgagccgtaacgtaccgtcgtcgacaccgtaccgacgtcccg

SEQ ID NO: 437836 - DNA, 541 bp, Homo sapiens
  misc_feature: GZ8MTXP02HSY4O.25.62.F07.1.454.CMB.2.raw
  modified_base (250)..(250): a, c, t, g, unknown or other
  modified_base (291)..(291): a, c, t, g, unknown or other
  modified_base (360)..(360): a, c, t, g, unknown or other
  modified_base (401)..(401): a, c, t, g, unknown or other
  modified_base (424)..(424): a, c, t, g, unknown or other
  modified_base (433)..(433): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttcctcccctcctcactctctgcacagggtctgaggcctctatgaggtgacacagccaccctcggtgtcagtgtccccaggacagacggccaggatcacctgctctggagatgctttgccaanacaatatggttactggaccagcagaaggcggcaggcccctntattgattaatatactctaggactactaaagaggtcccctagacgggactcccgtgacgcgtactttcncctggaccttccgagcgacagggtacaactgacactagttnaccatcagttgagtccagaccgngagacgagngtatactattactagtactacgtacagacgacgaccacactactacacgtcgtcgtcggacggacgacgaacgacgtaacgtacgtacgtcgtacgacgaccgacgcg

SEQ ID NO: 437837 - DNA, 592 bp, Homo sapiens
  misc_feature: GZ8MTXP02JMK0O.25.62.F07.1.454.CMB.2.raw
  modified_base (455)..(455): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcacggcccctcattgataatatatctggactctaaagaggccctgaggatcccgtgacgtcgattctctggctcagcgcgagggacagtgtcactattcgaccctatcgtatttgggattccccagtcccgtggaacgggacgtagggccttaggaaccttagtttaccgngttacgacgttacgagttacgaccgtacccactaactacctacgtacggtcgtccggttacggggacgggtacgggaccctaaggccttaacgggaccccgttcgtttacggggcctaacggcccccgaagggtccc

SEQ ID NO: 437838 - DNA, 621 bp, Homo sapiens
  misc_feature: GZ8MTXP02J249I.25.62.F07.1.454.CMB.2.raw
  modified_base (243)..(243): a, c, t, g, unknown or other
  modified_base (309)..(309): a, c, t, g, unknown or other
  modified_base (384)..(384): a, c, t, g, unknown or other
  modified_base (460)..(460): a, c, t, g, unknown or other
  modified_base (476)..(476): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagcccaccctcggtgtcagtcgtccccaggacagacggccaggatcacctgctcgtgganatgtctttgaccaacacaatagtggttactggtaccagacgaggaacggcggccacggtccccctntattgaattaactatatctaggacttcaagacggtcctgagggtactccgtgacgcgtactcgtcgtggcctcgngccgacgtacggactaacgtgtaccacgtattcgacctagtctaagtcggactccagccgtagggacgcggacgtntacgacttagttaccngtacgagtacgacgtacgaccgaccctaacctaccgtccgtaccggtaccggtccggtaccggggtaccggacgggaacggtaccgtaacggtcccggtaacggtacccgttccggtacggaccgaccggtacccggacgtcccg

SEQ ID NO: 437839 - DNA, 523 bp, Homo sapiens
  misc_feature: GZ8MTXP02INC4N.25.62.F07.1.454.CMB.2.raw
  modified_base (271)..(271): a, c, t, g, unknown or other
  modified_base (354)..(354): a, c, t, g, unknown or other
  modified_base (375)..(375): a, c, t, g, unknown or other
  modified_base (377)..(377): a, c, t, g, unknown or other
tcagactgtacagtcacgaccggtgctcgatttagtagtcgcataaagggaaaggggtccaggaggcagaactctgggtgtctcaccatggcctgggtccctctacttctcccctcctcactctctgcacagggtctgaggcctcctatgaggtgacacagcccaccctcggtgtcagtgtccccaggacagacggccaggatcacctgctctggagatgctttgccaacacaatatggttactggtaccagcagaaggcggcaggccctntattgataatatatctggactctaagaggccctcagggatccctgagcgattctctggctccagccgcagggacaactgtcanttgaccatcaattggatccancngagacgaggctgactattactgtcagtacagttagacgccaccataacctcaacgtcgacgttcggcggagggaccaagcgtcgaccgtccttaggtcacgacccaaggctcgcccccctcggtccacttcctcgtttccccgccc

SEQ ID NO: 437840 - DNA, 705 bp, Homo sapiens
  misc_feature: GZ8MTXP02ID75S.25.62.F07.1.454.CMB.2.raw
  modified_base (320)..(320): a, c, t, g, unknown or other
tcagactgtacagtcacgaccggtgctcgatttagtagtcgcataaaggggaaaggggggagcctagctgtgctgtgggtccaggaggcagaactctgggtgtctcaccatggcctgggtccctctacttcctcccctcctcactctctgcacagggtctgaggcctcctatgaggtgacacagccaccctcggtgtcagtcgtccccaggacagacggccaggatcacctgctctggagatgctttgccaaacactaaatatggttatggtaccagcagaaggcggcacggcccctctattgataatatatctggactntaaagacggccctacgacgggtactcccgtagacgcgtaatttcctctggccttccgagccgacgaacggggtaaccaaccgtgtacaaccatttacaaccctaatcctaaagtttcggacggttacccagtaccccgtagggaaggaaccggaaggggccttaggaaacctttaatttaaccgttgggttaccctaggttaccaaggtttaacgggacccgaccctaaacccaaccttaaaccttcccgaaccggtttaccggtccggttttacccggggacggggtaaacccgggggtaacctaaaacggacccgttccgggtaaccccggtttacccggtttcgggtaccgacccgggtacccgtaaaaccggggtcccccg

SEQ ID NO: 437841 - DNA, 495 bp, Homo sapiens
  misc_feature: GZ8MTXP02GSOQ1.25.62.F07.1.454.CMB.2.raw
  modified_base (267)..(267): a, c, t, g, unknown or other
  modified_base (296)..(296): a, c, t, g, unknown or other
  modified_base (362)..(362): a, c, t, g, unknown or other
  modified_base (426)..(426): a, c, t, g, unknown or other
  modified_base (438)..(438): a, c, t, g, unknown or other
  modified_base (449)..(449): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaaacacaatatggttacnggtaccagcagaaggcggccaggcccctntattgataatatatctggactctaaagaggccctcagggatcccctgacgcgattctctggctccngcgcagggacaactgtcacattgaccatcattggatcagcctgagcgaggctgactatactgtnagtcagtagacnccaccactacncacgtcgcgtcggacggacgacagctgacgtcgtcgcacgaccagc

SEQ ID NO: 437842 - DNA, 610 bp, Homo sapiens
  misc_feature: GZ8MTXP02GZB6B.25.62.F07.1.454.CMB.2.raw
  modified_base (301)..(301): a, c, t, g, unknown or other
  modified_base (443)..(443): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgtctttgaccaaacacaatatggttactggtaccagcagaaggcggccacggcccctntatgataatatatctggactcgtaagacggccctcgagggtactcccgtgacgcgtacttcgtcgtcggtcctccgagccgacgaacgggaaccaacgtcgacactattcgaaccctatctagttgaactcccgagtcccgngggacggacggaggtactaggtaaccttaattccgtaggttacaacgttacgaacgttacggacctacccaacctactaactccgaccggttcggtccggttacgggcgggaacggaccgaagtccgtaacgtacccgtcgtcggtaccacgacccgacggtccccg

SEQ ID NO: 437843 - DNA, 781 bp, Homo sapiens
  misc_feature: GZ8MTXP02HZSXZ.25.62.F07.1.454.CMB.2.raw
tcagactgtacagtcacgaccggtgctcgatttagtagtcgcataaagggaaaggggggagcctagctgtgctgtgggtccaggaggcagaactctgggtgtctcaccatggcctgggtccctctacttcctccccctcctcactctctgcacagggtctgaggcctcctatgaggtgacacagccacctcggtatcagtgtccccaggacagacggccaggatcactgctctggagatgctttgccaacacaatatggttactggtaccagcaggaaggcggccacggcccctctattgataatatatctggactacgtaagaggtcccctgaacggggtactccccgtaggaccgtacgtaactttccgtcgtcgggtacccttcccgacggcccggaacgaaccgggggaaaccctaaaaccgtttcggacctaaacccgtaatttaccgaaacccctaatttacccgaaggttttacggggaaacgtttaccccgaaaggccccttaggggaaacggggtaaacccgtaggggacctttagggaaacccttttaaggtttaaacccttggttaccgaaggttaccgaaaggttaacgaaccccggtaccccaaaccccgtaccgtaaaacccttcccgaaccgggtttacccggtccggtttaccgggggaccgggtaaccggggaacccgtaaaacggccccggttaacggtaaccccggttacccggtttccggggtacctaaccgggtaacccccgtaaacggggtccccccgg

SEQ ID NO: 437844 - DNA, 504 bp, Homo sapiens
  misc_feature: GZ8MTXP02HJ26D.25.62.F07.1.454.CMB.2.raw
  modified_base (249)..(249): a, c, t, g, unknown or other
  modified_base (347)..(347): a, c, t, g, unknown or other
  modified_base (356)..(356): a, c, t, g, unknown or other
  modified_base (382)..(382): a, c, t, g, unknown or other
  modified_base (393)..(393): a, c, t, g, unknown or other
  modified_base (396)..(396): a, c, t, g, unknown or other
  modified_base (405)..(406): a, c, t, g, unknown or other
  modified_base (414)..(414): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaanacaatatggttactggtaccagcagaaggcggccaggcccctctattgataatatatctggactctaagaggccctcagggatccctgacgcgattcnctggctccngcgcagggacaactgcacattgacancatgagtcacncgngagacgagnngatatatntcagacagacgacaccaccacactacacgtcgtcgtcggacggacggacgaacgacgtaacgacgtaccgtacgtacgacgaccgacgcg

SEQ ID NO: 437845 - DNA, 580 bp, Homo sapiens
  misc_feature: GZ8MTXP02JRW0C.25.62.F07.1.454.CMB.2.raw
  modified_base (294)..(294): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactcgtaagacgccctgagggactcccgtgacgcgtattcctcgtcggcctcacggcgacgaagggggaaccctaaacgttcggtaccaacctatttaccgaaccctatacctagttcgggaacttcccgagtcccgtaggacggacggacggctaggtactatttacctggtacagttcagtacgacgccacctactactacgacgtccgcggttccggcggtacggaccaagcgtcgaccgttcttcggcacgtacccgagtcccg

SEQ ID NO: 437846 - DNA, 527 bp, Homo sapiens
  misc_feature: GZ8MTXP02GYVR1.25.62.F07.1.454.CMB.2.raw
  modified_base (295)..(295): a, c, t, g, unknown or other
  modified_base (351)..(351): a, c, t, g, unknown or other
  modified_base (360)..(360): a, c, t, g, unknown or other
  modified_base (382)..(382): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagcggccctcagggactcccgtgacgcgattcnctggctccngcgcgagggacaactgtcaacnttgaccatcattgatccagcctagaggacgaggctgactattactgtacagtcagtagacgccaccactactcacgtcgccggttcggacggtacggaccaagccgtcggaccgttcccgttcggtaccacgacccgaggtcccg

SEQ ID NO: 437847 - DNA, 523 bp, Homo sapiens
  misc_feature: GZ8MTXP02JTNAM.25.62.F07.1.454.CMB.2.raw
  modified_base (439)..(439): a, c, t, g, unknown or other
  modified_base (492)..(492): a, c, t, g, unknown or other
  modified_base (509)..(509): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctgagggatcccctgacgcgattctactggccttccagccgacgacggggactaactgtcacattgaccatcattggagtccagcctgaggacgaggctgactattactgtanagtccagtacgacgccaccactacctcacgtcgcgttcggcgggacgacacgntcgaccgtcctggtacncgaccgacgtcccg

SEQ ID NO: 437848 - DNA, 552 bp, Homo sapiens
  misc_feature: GZ8MTXP02HIC4M.25.62.F07.1.454.CMB.2.raw
  modified_base (352)..(352): a, c, t, g, unknown or other
  modified_base (372)..(372): a, c, t, g, unknown or other
  modified_base (399)..(399): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgaccaacacaatatggttactggtaccagcaaggaaggcgggaccacggcccctcgtattgataatatatctggactactaaggacggccctcgagggactccccngacgcgtattctcgtgctcngcgacgagggacatcgcacatgacctntactagttggagtccagccgtgaggacgaggctgaacttattatcgtacacgtcaggtacgacgccacacttacacacggtcgaccggttacgggacggtacggacctaagcgtaacggacccgttcgtacggtccgacgccgtaacgtcccg

SEQ ID NO: 437849 - DNA, 596 bp, Homo sapiens
  misc_feature: GZ8MTXP02HH5GO.25.62.F07.1.454.CMB.2.raw
  modified_base (254)..(254): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatcacctgctctggagatgctttgccaanacaatatggttactggtaccagcagaaggcggccacggcccctgtatgataatatatctggactctaaagacggtccctgacgggactcccctgacgcgtattctcgtggctacgagcgacaggggtaccaaacgttgtacactatacgaacctatacgtagtcggactaccgacgtcgtaggacggacgtacggtctagtaacttaagttacgtgtacgtacgtacgtacgtaacgaccgacccaaccctaacctaacctaccgtaccgtccgtacggtacgggaccggacggaaccgaacgacgtaacgtaccgtccgtcgtacgaccgaccgacgtccg

SEQ ID NO: 437850 - DNA, 721 bp, Homo sapiens
  misc_feature: GZ8MTXP02GOLU3.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgacccaacacaatatggttactggtaccagacaggaaggccggccacggcccctatattgaattaatatatcgtaggactcgtaagacggccctcgagggtactccccgtgacgcgtattctcgtcggcctacgacggccgcgaacggggaactaaccgttggtaccaaacgtatttcgaaacccattacctaagtttcgggaaacgttccccaggtaccccgttagggaacgggtaaccggaacggggtccttaacggtactttaactttaaccgttggttaccaacggtttaccgaggtttaaccggaaccgacccctaaaccccgtaacccgttaacctaccgtaacccggttccggtccgggtttacccgggggacgggaaccggggtaaccccgaaacggtcccgttaaccgggtacccccggttaccggttaccggtcccgaaccgggacccgtaacgggtcccccgg

SEQ ID NO: 437851 - DNA, 690 bp, Homo sapiens
  misc_feature: GZ8MTXP02F5PCC.25.62.F07.1.454.CMB.2.raw
  modified_base (297)..(297): a, c, t, g, unknown or other
  modified_base (363)..(363): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgtctttgaccaacacaatatggttactggtaccagcagaaggcggccacggcccctntatgataatatatctggactactaagcgccctgaggactccctgacgcgtattctctggcctaccngcgcgagggaccaacgtgtacacattacgaccctatctagttcggaacgtccaacgtcccgtaggaaacgggacggaaacggtccgtacggtaacctttagtttaacccgttagggttacccaaggtttaccgaaggttaaacggaccccggaaccccgaacccgtaacccgttaacctacccgtaaccgggttacccgggtcccggtttacgggggacccgggggtaaacggggaaaccccgaaacgggtcccgtttaacggaaacccccggtttaccgtttccggggtaccgtaaacccggtcccccgaaaacggttccccccgg

SEQ ID NO: 437852 - DNA, 492 bp, Homo sapiens
  misc_feature: GZ8MTXP02HO5I0.25.62.F07.1.454.CMB.2.raw
  modified_base (326)..(326): a, c, t, g, unknown or other
  modified_base (355)..(355): a, c, t, g, unknown or other
  modified_base (449)..(449): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctnagggatccctgacgcgattctctggctcngcgcagggacaactgtcacattgaccatcattgatccagcctgaggcgaggctgacttatactgtcagtcagtgacgccacactactcacgtcncgttcgcggaggccaagctgaccgtcttggcacgccaaggtcc

SEQ ID NO: 437853 - DNA, 499 bp, Homo sapiens
  misc_feature: GZ8MTXP02FOTGJ.25.62.F07.1.454.CMB.2.raw
  modified_base (293)..(293): a, c, t, g, unknown or other
  modified_base (328)..(328): a, c, t, g, unknown or other
  modified_base (357)..(357): a, c, t, g, unknown or other
  modified_base (477)..(477): a, c, t, g, unknown or other
  modified_base (489)..(489): a, c, t, g, unknown or other
tcagactgtacagtcacgaccggtgctcgatttagtagtcgcataaagggaaagggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaaagaggccctnagggatccctgacgcgattctctggctcngcgcagggacaactgtcactattgaccatcattggagtccagcctgaggacgaggctgactattactgtcagtcagtagacgccacactactcacgtcgcgttcggcgacggaccaagcngacgtctggacncgccagtccg

SEQ ID NO: 437854 - DNA, 601 bp, Homo sapiens
  misc_feature: GZ8MTXP02H301S.25.62.F07.1.454.CMB.2.raw
  modified_base (382)..(382): a, c, t, g, unknown or other
  modified_base (449)..(449): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccgtcggtgtcagtcgtccccaggacagacggccaggatcactgctctggagatgtctttgaccaaacaacaatagtaggttactggtaccagacaaggaacggccgggaccacggcccctacgttattacgaattaaatatactcgtaggactactaaggaccggcctagacggtactccgtgacgcgtattcncgtcgctcgcgcgcgaggacatcgtacatctacgactatcagtggactccacgtccgaggacgacgnggtactagaactttatacgtagtacgtagtacgaggtacgacgacccaactaccgtactcgaacgttccggtccggttacggggacggtaaccggaaccgacgtccgtaaccggtccgttacggttcggacgacccgtaccgacggtccccg

SEQ ID NO: 437855 - DNA, 646 bp, Homo sapiens
  misc_feature: GZ8MTXP02G2LQM.25.62.F07.1.454.CMB.2.raw
  modified_base (297)..(297): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtgtccccaggacagacggccaggatcacctgcttctggagatgctttgccaacacaatatggttactggtaccagcagaaggcggccaggcccctntattgataatatatctaggactctaagcgccctgagggactcccgtgacgcgattctctggcctcagcgcgagggacaactcgtacactattgaaccataccaatttggggacttccccgaagtcccgtagggacggaccggaagggtccgtaggtaaccttaagtttacctgggttacacgggttaccaaggttacgaccgacccaacctaactacccgttaccgacggttcccggtaccggtttccggggaccgggaacggggaaacccgaacggtcccgtttaacggaaccccggtttcccgtttacggggtcccaaacgggtcccccgaaaacgggttcccccgg

SEQ ID NO: 437856 - DNA, 614 bp, Homo sapiens
  misc_feature: GZ8MTXP02IG7C2.25.62.F07.1.454.CMB.2.raw
  modified_base (302)..(302): a, c, t, g, unknown or other
  modified_base (316)..(316): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacacgccaccctcggtgtcagtcgtccccaggacagacggccaggatccacctgctctggagatgtctttcgaccaaacactaatatggttactggaccagcagaggcggccacggccctntatgataatatatntaggactacgtaagacgtccctcgaacgggacctccgtagacgtaccgtactttctacgtcggtcctccgaggccgacgacggggaacctaacgtcgtaccacgtattacgaacctatactagttacgacgtccacgcccgtaggacggacgacggtctagtaacttattacgtgtacgtagtacacgtacgaccgacccaccctactaccctcgacggttccgtcggttcggacggtacggaacctaacgccgtaacgtccgttaccgtacggtaccgtacgacccgaacggtcccg

SEQ ID NO: 437857 - DNA, 605 bp, Homo sapiens
  misc_feature: GZ8MTXP02HW9OA.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcaggaaggcggccacggcccctctattgataatatatcgtggtactactaaagacggtccctcgagggactcccgtgacgcgtacttcgtgtcggtcctccgacgccgacgaacggggacctaaacgtcgtacaacgtacttacgaacctatctagttcgaacgtccaacgccgtagggacggaacggaggtcctaggtaacctttagttacgtagtacctagttacaaggtacgacccaccaacctacctactccgacgttccggacgtcggacgggacgaccaagccgtaacgaccgtccgttacggaccaccgaccgtaacgccccgg

SEQ ID NO: 437858 - DNA, 537 bp, Homo sapiens
  misc_feature: GZ8MTXP02FJSCQ.25.62.F07.1.454.CMB.2.raw
  modified_base (274)..(274): a, c, t, g, unknown or other
  modified_base (366)..(366): a, c, t, g, unknown or other
tcagactgtacagtcacgaccggtgctcgatttagtagtcgcataaagggaaaggggggtccaggaggcagaactctgggtgtctcaccatggcctgggtccctctacttctcccccctcctcactctctgcacagggtctgaggcctcctatgaggtgacacagccaccctcggtgtcagtgtccccaggacagacggccaggatcacctgctctggagatgctttgccaacacaatatggttactggtaccagcagaggcggcaggcccctntattgataatatatctggactctaagacggccctagagggactcccctgacgcgattctcgtggctccgagcccgcagggacaactgtcacntgaccatcattgggatccagcctgagacgaggctagactattactgtcagtcagtagaccgccaaccgactactcgacgtcgtcgttcggcgggacggaccaaggcgtcgaccgtcgtcggctacgacccaggcctcgcccccgtacgtccacctcgtccgttccccaccc

SEQ ID NO: 437859 - DNA, 687 bp, Homo sapiens
  misc_feature: GZ8MTXP02JEJSC.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagaccggccaggatcacctgctctggagatgtctttgaccaacacaatatggttactggtaccagcagaaggcggcacggcccctctattgataatatatctggactcgtaagacgttcctcgagggactccgtgacgacgtagttcctcgtcggtacctccgacggccgacgacgggaactaacgtcgtacactattcgactactctagttggactcccagtacctaggacggacgacgggtacttacggaaccttacgtttaacgtcgggtactaacgttaccgaagttaaccggaccacccctaaccgtaaccctaaccgttccgtaacccggttaccgggtaccgggtttcccgggggaacgggggtaaccggggtaaaccccgaaacggtcccgttaaacccgggtaccccggtttcccggtttacggggtacccgtaaccggtacccccgggaaacggtttccccccgg

SEQ ID NO: 437860 - DNA, 587 bp, Homo sapiens
  misc_feature: GZ8MTXP02F8JN8.25.62.F07.1.454.CMB.2.raw
  modified_base (296)..(296): a, c, t, g, unknown or other
  modified_base (361)..(361): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntatgataatatatctggactctaagcggccctgagggactccctgacgcgtattctctggcctcngccgcgagggacaactgtcactattcgaccatacagttggactccgagtccgtggaacggacggaaggcctaggtacttattaccgtgttacacgtacgaagtacgaccgacccacctaccttacctcgtaccggtccggtaccgggttccgggacgggaacgggacccgaaggtccgtaacggtacccgttccgttacggaccaccggaccccgaacggtccccg

SEQ ID NO: 437861 - DNA, 544 bp, Homo sapiens
  misc_feature: GZ8MTXP02GLE6L.25.62.F07.1.454.CMB.2.raw
  modified_base (361)..(361): a, c, t, g, unknown or other
  modified_base (441)..(441): a, c, t, g, unknown or other
tcagactgtacagtcacgaccggtgctcgatttagtagtcgcataaagggaaagggggggtccaggaggcagaactctgggtgtctcaccatggcctgggtccctctacttctcccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctatgataatatatctggactctaagaggccctcagggatcccctgagcgattctctggctccagccgcagggacaactgtcacnttgaccatcattggactccagcctggaggacgaggctagactattacgtgtacagtcagtacgaccgaccaccacgtacnccgacgtcgtcggttacggcggacggacctagtcgacccgtcctcggtcacgcccgaaggcctccgcccccgtcggtcaccgtctccgttccccgcccttccc

SEQ ID NO: 437862 - DNA, 687 bp, Homo sapiens
  misc_feature: GZ8MTXP02G7ZKX.25.62.F07.1.454.CMB.2.raw
  modified_base (299)..(299): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaacacaatatggttactggtaccagcagaaggcggaccaggcccctntatgataatatatctggactcgtaagacggccctcgaagggactccccgtagaccgtcgtactttccgtctcggaccttccgacggcccgacggaaacgggggaacctaaaccgttcgttaccaaactaacgtttacgaaccctataccgtaagtttacggggaacttccccgaaggtaccccgtagggaacgggaacggaagggtcccttaggtaacccgtttaatttaacccgtgttaccgaacggttacctaaaggtacgaacccgtaccaaacccgtacttaccctacgaccgttcggtacccggttcgggacgggaacgggacctaacgccgtaacggtaacccggttcgtttacggaccgaccggacccgtaagggtccccg

SEQ ID NO: 437863 - DNA, 524 bp, Homo sapiens
  misc_feature: GZ8MTXP02ILY47.25.62.F07.1.454.CMB.2.raw
  modified_base (365)..(365): a, c, t, g, unknown or other
  modified_base (442)..(442): a, c, t, g, unknown or other
  modified_base (454)..(454): a, c, t, g, unknown or other
  modified_base (464)..(464): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacgccaggatcacctgctctggagatgctttgccaacacaatatgttactgtaccagcagaggcggccacggcccctctattgataatatatctggactactaagacggccctcgagggactacccgtgacgcgacttctctggcctcngcgacgagggaccaacgtgtacacattcgacctatctattgacgtcagctagagacgaggcctagacttatactcgnacgtcatcgacnccacactacncacgtcgcgttcggacgcgggaaccagacgtcgaccgtcttcggcacgccgaaggtcccg

SEQ ID NO: 437864 - DNA, 509 bp, Homo sapiens
  misc_feature: GZ8MTXP02FL9YZ.25.62.F07.1.454.CMB.2.raw
  modified_base (484)..(484): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggcccctctatttgataatatatctggactctaaagaggccctcaggggatcccctgacgcgattctctggctccagcgcagggacaactgtcacattgacccatcattgagtccagcctgaggacgaggctgactattactgtcagtcagtagacgccaccactactcacgtcgccgttcggcggacggaccagcngaccgtctggtcacgcccaggtccg

SEQ ID NO: 437865 - DNA, 553 bp, Homo sapiens
  misc_feature: GZ8MTXP02IU2CT.25.62.F07.1.454.CMB.2.raw
  modified_base (297)..(297): a, c, t, g, unknown or other
  modified_base (366)..(366): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaacacaatatggttactggtaccagcagaaggcggccacggcccctntattgataatatatctggactctaagacggccctcgaagggctcccgtgacgcgtattctctggcctcnggcgacgaggggaccaactcgtacactattagaccctatcagttggactcccaagcccgagaggacgagctagactttagtactgtcagtcagtacgacgaccaaccactaactcacgtcggtccggttcggacggacggaccaagcttcggaccgttcgttacggacaccggaccaacggtccccg

SEQ ID NO: 437866 - DNA, 506 bp, Homo sapiens
  misc_feature: GZ8MTXP02GH5CL.25.62.F07.1.454.CMB.2.raw
  modified_base (295)..(295): a, c, t, g, unknown or other
  modified_base (351)..(351): a, c, t, g, unknown or other
  modified_base (358)..(358): a, c, t, g, unknown or other
  modified_base (423)..(423): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagcccaccctcggtgtcagtgtccccaggacagacggccaggatcacctgctctggagatgctttgccaacacaatatggttactggtaccagcagaaggcggccaggcccctntattgataatatatctggactctaaagcggccctgagggatccctgacgcgattcnctgctcngcgcaggaccaactgtcacattgaccatcattgagtccagcctgagacgagctgactattactgnagtcagtacgacgccacactactcacgcgcgttcgggacgcgggaaccagctcgaccgtcctggtccacgaccccaaggcccg

SEQ ID NO: 437867 - DNA, 675 bp, Homo sapiens
  misc_feature: GZ8MTXP02GBL9F.25.62.F07.1.454.CMB.2.raw
  modified_base (302)..(302): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgtctttgaccaaacacaatagtggttactggtaccagcaggaaggcggccacggcccctntattgataatatatctaggactacgtaagacggccctacgagggactcccgtgacgcgtacttcgtcgtcggcctcgacgccgacgaacggggaaccaacgtcgtacaactagttacgaaccctatctaagtttcggactcccgaagtcccgtaggaacgggacgtaaggggtccttaggtaacctttaagtttaccgtaggttaccgaacgttacgaagggtaaccgacccggtacccaaaccctaacctaccgtacccgtaacggttccggtaccgggttacggggaccgggtaaccggggaacccaacgggtccgtaaccggtaccccggttcgttaccgggacctaccggaccccgtaacgggtccccg

SEQ ID NO: 437868 - DNA, 579 bp, Homo sapiens
  misc_feature: GZ8MTXP02JVZF2.25.62.F07.1.454.CMB.2.raw
  modified_base (196)..(196): a, c, t, g, unknown or other
  modified_base (298)..(298): a, c, t, g, unknown or other
  modified_base (360)..(360): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtntcagtgtccccaggacagacggccaggatcacctgctctggagatgctttgcccaacacaatatggttactggtaccagcaggaaggcggccacggcccctntatgataatatatctaggactctaagacgccctacgaggggactcccgtgaacgcgtattcncgtggcctcagccgacagggacaacgtgtcaactacgttacacccatactagtttaggacgtcccaagcccgtaggacggacggaggccgtaggtaaccttaagttacgtcggtacacgttacgaagtacgaccgcccaacactaccgtacacgttccgcgttcggacggacggaccgaagcgtaacgacccgtcgttcggccacgacccgaagtcccg

SEQ ID NO: 437869 - DNA, 585 bp, Homo sapiens
  misc_feature: GZ8MTXP02IR3HG.25.62.F07.1.454.CMB.2.raw
  modified_base (275)..(275): a, c, t, g, unknown or other
  modified_base (370)..(370): a, c, t, g, unknown or other
tcagactgtacagtcacgaccggtgctcgatttagtagtcgcataaagggaaaggggggtccaggaggcagaactctgggtgtctcaccatggcctgggtccctctacttctcccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggcaggcccctntatgataatatatctggactctaagacggccctgagggactccccgtgacgcgtattctcgtggctccagccgacgagggacaacgtgtacactnttcgaacctatcctagttggacgtccacgtctaggacggacgaggctagtacttattacgtgtacagtacagtacgaccgtaccacctacgtacctcgacgtcgtcggtcgggcggaggtatacgagtctacggtacccgtcgtcggtaccaccgacccgaaggcccgttcccggcccccgttacggtcctaccgttccgttcccggttcccccg

SEQ ID NO: 437870 - DNA, 609 bp, Homo sapiens
  misc_feature: GZ8MTXP02G3A19.25.62.F07.1.454.CMB.2.raw
  modified_base (305)..(305): a, c, t, g, unknown or other
  modified_base (310)..(310): a, c, t, g, unknown or other
  modified_base (321)..(321): a, c, t, g, unknown or other
  modified_base (341)..(341): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacacgccaccctcggtgtcagtcgtcccaggacagacgccaggatcacctgctcgtggagatgtctttgaccaaacactaatagttggttactggtaccagcaggaaggcggccacggcccctntattnataatatatcnggactataaggacgccctanaggggtactcccgtgaccgcgtacttcgtcgtcgtcctaccgacgccgacggacgggaacctaacgtcgtacactacgttacgacctatcgtagttcgacgtccgaacgtcgtaggacggacggagtcgtacgtacttacttacgtgtactaacggtcaagggtacaccgacccacctaacgtactcgtacgtcgtaccggtcgggaacgggacggacctaaggccgtaacggtaccgtcggttacgaccgacgacccggacgtcccg

SEQ ID NO: 437871 - DNA, 603 bp, Homo sapiens
  misc_feature: GZ8MTXP02FPGDE.25.62.F07.1.454.CMB.2.raw
  modified_base (278)..(278): a, c, t, g, unknown or other
  modified_base (304)..(304): a, c, t, g, unknown or other
  modified_base (366)..(366): a, c, t, g, unknown or other
tcagactgtacagtcacgaccggtgctcgatttagtagtcgcataaagggaaagggggggtccaggaggcagaactctgggtgtctcaccatggcctgggtccctctacttctcccccctcctcactctctgcacagggtctgaggcctcctatgaggtgacacagccaccctcggtgtcagtgtccccaggacaggacggccaggatcacctgctctggagatgctttgccaacacaatatggttactggtaccagcagaaggcggccaggcccctntatgataatatatctggactctaagnggccctgagggactccctgagcgattcgtctggctccgagccgacagggacaacgtgcactntagaccatcagttgactccagcctgaggtacgagctgaccgttatacgtgtcagttacaagtacgaccgtaccaaccctacttacctcccgacggtcgtccggtttacggggcggtaacggggataccgaaaggtccgtcgtacccgttccgttacgggcccaacggtccccgtaaaggcccgtcccggtaccccccgttcggggtacctacccggttcgttccccggtttcccccg

SEQ ID NO: 437872 - DNA, 594 bp, Homo sapiens
  misc_feature: GZ8MTXP02HUD30.25.62.F07.1.454.CMB.2.raw
  modified_base (194)..(194): a, c, t, g, unknown or other
  modified_base (267)..(267): a, c, t, g, unknown or other
  modified_base (296)..(296): a, c, t, g, unknown or other
  modified_base (356)..(356): a, c, t, g, unknown or other
  modified_base (369)..(369): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttcctcccctcctcactctctgcacagggtctgaggcctcctatgaggtgacacagccaccctggtntcagtcgtccccaggacagacggccaggatcacctgctctggagatgctttgaccaaacacaatatggttacnggtaccagcagaaggcggccaggcccctntatgataatatatctggactctaaagcgccctcgagggtactcccgtgacgcgtatttcncgtggaccctccnggccgccaaggggaccctaaacgtcgtactaccattacgacccaatacctagttcgggaaacgttccgaacgtcccgtaggaacggaccgaagggtccttagaactttagtaacctgtaccagttaccagtaacgctaccacactactcacgttcgcgttcgggacgacggtaccaagcgtaaggtaccccgttctttacggacaccggacccgaagggtccccg

SEQ ID NO: 437873 - DNA, 602 bp, Homo sapiens
  misc_feature: GZ8MTXP02GTLXP.25.62.F07.1.454.CMB.2.raw
  modified_base (196)..(196): a, c, t, g, unknown or other
  modified_base (296)..(296): a, c, t, g, unknown or other
  modified_base (360)..(360): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtntcagtcgtccccaggacagacggccaggatcacctgctctggagatgctttgccaacacaatatggttactggtaccagcagaaggcggccaggcccctntattgataatatatctggactctaaagacggccctgaagggtactcccgtagacgtcgatttcncgtggctcgagcgcagggacaactgtacactagttcacctatactagttggaacgtcccgagtcccttagggacggtaacggacgggtccttaggaacctttattaaccgttgtacccgtagttaccgaagttaacgaccgtacccaacctaactacctacgaccggttccgtaccggttcgggacggacgggacccaagccgtaacgtaccgtcgttacggccgacgacccgaacggtccc

SEQ ID NO: 437874 - DNA, 513 bp, Homo sapiens
  misc_feature: GZ8MTXP02F397F.25.62.F07.1.454.CMB.2.raw
  modified_base (267)..(267): a, c, t, g, unknown or other
  modified_base (296)..(296): a, c, t, g, unknown or other
  modified_base (328)..(328): a, c, t, g, unknown or other
  modified_base (333)..(333): a, c, t, g, unknown or other
  modified_base (358)..(358): a, c, t, g, unknown or other
  modified_base (396)..(396): a, c, t, g, unknown or other
  modified_base (437)..(437): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtccagtgtccccaggacagacggccaggatcacctgctctggagatgctttgccaacacaatatggttacnggtaccagcaggaagcggccaggcccctnattgataatatatctggactctaagagccctnaaggntccctgacgcgatctctggctccgngcgcagggactactgtcactatcgaccaatcattgacnccagcctgaggacgagctagactatactgtcagtacagtanacccgacactactacgcacggtcgacgtcggcggacggaccaagctaagccgtccttaggcacgacccctagcccg

SEQ ID NO: 437875 - DNA, 608 bp, Homo sapiens
  misc_feature: GZ8MTXP02HJ7QF.25.62.F07.1.454.CMB.2.raw
  modified_base (295)..(295): a, c, t, g, unknown or other
tcagactgtacagtcacgaccggtgctcgatttagtagtcgcataaagggaaagggggggtccaggaggcagaactctgggtgtctcaccatggcctgggtccctctacttctcccccctcctcactctctgcacagggtctgaggcctcctatgaggtgacacagcccaccctcggtgtcagtcgtccccaggacagacggccaggatcacctgctctggagatgtctttgacccaaacactaattagttgggttacctgggtaaccaggcaaggaaggccggccaggcccctntattgataatatatctggactctaagcggccctgacgggactcccgtagacgcgtattccgtctggtcctccgacgccgcgaagggactaacgttgtaccactattacgacctagtccagtttggactcgagctggagacggagcgtagtacttagtacgtgtacagtacgagtacgaccgtaccactacctacacgacgtcgtcggtcggacggacgggacacgcgtacgaccgttccgtggtaccacgaccgtaacgccgtcccggtccccgtcggtaccctaccgtccgttcccggtcccccttaccccg

SEQ ID NO: 437876 - DNA, 774 bp, Homo sapiens
  misc_feature: GZ8MTXP02G946Z.25.62.F07.1.454.CMB.2.raw
  modified_base (296)..(296): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctggagatgctttgccaacacaatatggttactggtaccagcaggaaggcggccaggcccctntatgataatatatctggactacgtaacgacggtccctacgagggtactcccgtagacgccgtattcgtcgttgggccttccacgggccgacgaaacgggggaaccaacgttgtaccaactattacgaaccctatactaagttcgggacgttcccgaacgtcccgtagggaacgggacggacggggtaccttacgggtaaacctttaagtttaaccgttcgggttaccgtaaacgggttaccgtaaacgggttaaacggaaccccggttacccgaaaacccccgtaccccgtttaaaacccgttacccggtaaaccccgggtttcccgggtccccgggggttttacccgggggaccgggggtaaaacccgggggtaaaccccggaaacgggttacccggtaaccggggttacccccgggtttaccggtttccggggttacccgaacccgggacccccggttaaaccgggtacccccggg

SEQ ID NO: 437877 - DNA, 675 bp, Homo sapiens
  misc_feature: GZ8MTXP02GZBQC.25.62.F07.1.454.CMB.2.raw
  modified_base (323)..(323): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagcccaccctggtgtcagtcgtccccaggacagacggccaggatccacctgctcgtggagatgtctttgacccaaacactaatagttggttactggtaccagacaggaacggccggccacggcccctatattgattaatntatcgtggactcaagcgccctcgaggtctcccgtgaccgtcgtactttccgtcgtcggtcctaccgcggccgaccggaacggggaacctaaaccgttgtaccaacgtaacgttccgaaaccctataccgtaagtttcggggaccttcccgacggtacccgtagggaacgggacggaggtaccggtaaactttacgtttaacgcgttacgacgtacaaggtaccgaccgaccctaaccaaccgttacctaccgtaccggtcggtccggttacgggacgggaacgggtaccaacggtccgttacggtaacccgttccgttacggtaccgacgtacccgaacgggtcctccccgg

SEQ ID NO: 437878 - DNA, 758 bp, Homo sapiens
  misc_feature: GZ8MTXP02ISZ0F.25.62.F07.1.454.CMB.2.raw
  modified_base (382)..(382): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggactcacctgctctggagatgtcttgccaacacaatatggttactggtaccagcagaaggcggccaggccccctactattgattaatatatctggaactctaagacggcccttcgaggggacctcccgtaggacgcgtattctcgtcgggtaccttccnggtccgacgaacggggacctaaacgtcgtacctaactacgtttagaacccctattactagtttaggggaaacgtcccgtaacggtccccgtagggaacgggaccggttaaagggcccgttaggtaaaccctttagtttaacccgttgggttacccaaggttacctaacggttaacggtaaccccggccctaaaaccccgtaccttaacccgttacccggtaacccggtttcccggggtccgggttttacccgggggaccgggggtaaaaccgggggtacccccgaaaacggttccccggttaacggtaacccccggtttcccgtttaaccggggttcccgtaaacccggacccccgtaaacggggtttccccccgg

SEQ ID NO: 437879 - DNA, 602 bp, Homo sapiens
  misc_feature: GZ8MTXP02HNQ2U.25.62.F07.1.454.CMB.2.raw
  modified_base (298)..(298): a, c, t, g, unknown or other
  modified_base (313)..(313): a, c, t, g, unknown or other
  modified_base (366)..(366): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacacgccaccctcggtgtcagtgtccccaggacagacggccaggatcacctgctctggagatgctttgaccaaacacaatatggttactggtaccagcagaaggcggcacggcccctntatgataatatatcnggactctaagacggccctacgagggactccctgacgcgtattctctggcctcngcgcacgggacaaactgtcactattcgacctatcagtttaggacgtccacgccctaggaggaccgagggccttgaacttacttactcggtactagtacgaagtacgaaccggcccaaccacttacctaccgtaccggttccggaccggtttaccgggaccggggtacgggaacccgaacggtccgtaaccggacccgtccgtttcgggaccaccggtccccggtaaacggtccccg

SEQ ID NO: 437880 - DNA, 656 bp, Homo sapiens
  misc_feature: GZ8MTXP02HIIS4.25.62.F07.1.454.CMB.2.raw
  modified_base (320)..(320): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatccacctgctctggagatgctttgacctaacacaatatggttactggtaccagcaggaaggcggccacgggcccctctatgactaaatataactcnggtaactcttaaagacggtcccctcgaaggggtatcccgtgaacgcgattctctggccttccagtcgacgaaggggaccctaaacgtcggtactactaacttcgaaaccctatacctaacgtttaggggaaacttccccgaaaggtcccgttaggtaccgggaaccggaaagggtctacggtaacctttaaagttccttaggtaccgagttacgtaacgtacgaaccggtaccacctaactaacgttcgaacggttccgtcggtttacgggaccgggacgggtaaccaacggacctcggccgtacccgttcggactaccgtcccgaacggtccccg

SEQ ID NO: 437881 - DNA, 756 bp, Homo sapiens
  misc_feature: GZ8MTXP02ITVZ7.25.62.F07.1.454.CMB.2.raw
  modified_base (299)..(299): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggccctcctatgaggtgacacagccaccctcggtgtcagtcgtccccaggacagacggccaggatcacctgctctggagatgctttgaccaacacaatatggttactggtaccagcaggaaggcggccaggcccctntattgataatatatctggactctaagacgtcctacgaggactccctgacgcgtattcctcgttcggcctccaggccgaccgaacgggggaacctaaccgttggtaccaaccgtatttcgaaccctatacctagtttgggaacgttcccgaaacgtcccgtagggacgggaaccgggtaacgggaccgttacggtaacctttaagttttacccgtaggtttaccgaaacgtttaccgaaagggttaacggtaaccccggacccctaaacccgtaacctttaacccgtttacccgtaaaccgggtttacccggtccccggggtttttaacccggggggaccggggttaaaccgggggtaaccccgaaaacggggttccccgtaaaccggttaacccccgggtttcccgtttacgggggtacccttaacccggacccccggtaaaacggggtttcccccg

SEQ ID NO: 437882 - DNA, 501 bp, Homo sapiens
  misc_feature: GZ8MTXP02F913V.25.62.F07.1.454.CMB.2.raw
  modified_base (295)..(295): a, c, t, g, unknown or other
  modified_base (359)..(359): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagaggccctcaggggactccctgacgcgattctctggctcngcgcagggacaactgtcacattgaccatcattgatccagcctgagacgaggctgactatactgtcagtcagtgacgccaccactactcacgctacggttcggcggaggaccaagctcgacgtctcggtacacgccaaggccc

SEQ ID NO: 437883 - DNA, 595 bp, Homo sapiens
  misc_feature: GZ8MTXP02FNV1R.25.62.F07.1.454.CMB.2.raw
  modified_base (307)..(307): a, c, t, g, unknown or other
  modified_base (378)..(378): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggccctcctatgaggtgacacagcccaccctcggtgtcagtcgtccccaggacagacggccaggatccacctgctctggagatgcttgaccaacacaatatggttactggtaccagcgaggaaggccgggaccacggcccctntatgataatatatctggactacgtaagcggccctacgagggactcccgtgacgcgtattctcgtgcctcgngcgcgagggacactgacatacttgaaccctatactagttgggacgtaccgacgtccgtaggacggacgaggctagtacttattactgtacacgtgaacgtacgaccgacccaacctactacctcgaccggttcggaccggttcgggaccgggacggaacccgaaggtccgtaacggtacccgttccgttacggaccaccggacccgaaggtcccccg

SEQ ID NO: 437884 - DNA, 561 bp, Homo sapiens
  misc_feature: GZ8MTXP02JR7A4.25.62.F07.1.454.CMB.2.raw
  modified_base (266)..(266): a, c, t, g, unknown or other
  modified_base (358)..(358): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttacnggtaccagcagaaggcggcacggcccctgtattgataatatatcgtggactctaaagacggccctgagggactcccgtgacgcgtattctcnggcctcgagcgcgaggggacaactgtacacgtattcgaacctatcagtttcggacgttcccaagtcccgtaggacgggtaccgaagggtcctaggtaaccttagttacgtacggttccaagttcgaacggtacgacgacccaactactactcgacgtcgcgtcggacggacggaccagctgaccgtctcggcaccgcagcccg

SEQ ID NO: 437885 - DNA, 541 bp, Homo sapiens
  misc_feature: GZ8MTXP02IHKTS.25.62.F07.1.454.CMB.2.raw
  modified_base (240)..(240): a, c, t, g, unknown or other
  modified_base (293)..(293): a, c, t, g, unknown or other
  modified_base (348)..(348): a, c, t, g, unknown or other
  modified_base (356)..(356): a, c, t, g, unknown or other
  modified_base (410)..(410): a, c, t, g, unknown or other
  modified_base (441)..(441): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtgtccccaggacagacgccaggatcacctgctctggagntgctttgccaacacaatatggttactggtaccagcagaggcggcaggcccctntatgataatatatctggactactaagaggccctgagggactcctgacgcgattcntggctccngcgcagggaccacgtcgtacacattcgacctaatctattggagtcccaggtccngagacgagcttgacttattactgtcacgtanagtacgacgccacctactactacgacgtacgtccggtacggacggacgaaccgtagaccgtaaccgtaccgtcgttacggtacgaccgaccgacggtccg

SEQ ID NO: 437886 - DNA, 564 bp, Homo sapiens
  misc_feature: GZ8MTXP02JU7KM.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctctattgataatatatctaggactcgtaaagcggccctcgagggactcccgtgacgcgtattctctggcctccagccgacacggggaccaacgtgtaccacattcgaacccattcctagttacggatcccaagtcctagggacggacgaggctgacttattactgtcagtcaagtacaccgccaccgtacactcgaccgtcgccggtacggacggacggaccacggactccggtcctaccgtcggtacgaccgtacccgaacggtcccg

SEQ ID NO: 437887 - DNA, 676 bp, Homo sapiens
  misc_feature: GZ8MTXP02F8FRG.25.62.F07.1.454.CMB.2.raw
  modified_base (239)..(239): a, c, t, g, unknown or other
  modified_base (295)..(295): a, c, t, g, unknown or other
  modified_base (369)..(369): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctgganatgctttgccaacacaatatgttactggtaccagcagaaggcggccacggcccctntattgataatatatctggactactaagacggccctacgaagggactccccgtgacgcgtattctctcggcctcngcgcgaaggggacctaacgtcgtacactattacgaccctatacctaagttcgggtaacgtcccgaacgtcccgtagggaaacgggaccgaacgggccttaggtaaccttaatttaaccgtgttacgaacgttacgtaacggttaacggaaccggtacccaaaccgtaactaacccgttaccgtaaaccggttcccggtaccgggtttaccgggggaccggggtaacggggaacccgaaacggtcccgtaacggtaaccccggtttccgttacgggttacccgaccggtacccgaaaccggtccccgg

SEQ ID NO: 437888 - DNA, 629 bp, Homo sapiens
  misc_feature: GZ8MTXP02F6LF2.25.62.F07.1.454.CMB.2.raw
  modified_base (301)..(301): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagaccggccaggatcacctgctctggagatgtctttgaccaacacaatatggttactggtacagcaggaaggcggccacggcccctntattgataatatatctggactctaagacgccctcgagggactcccgtagcgcgtattcctcgtcggccttaccacggccgacggaaggggacctaacgtgtaccactaagttcgaaccctatctagtttggactccagccgtaggacggacgaggtcctagtaaccttagtttacgtacggtactaacggtcaaaggtacgaaccggaccctaacctacttaaccctcgtaccggttccggtccgggttacgggcgggtaaacggacccgtaggtcccgtaacggtaccccgttcgttacgggaccaccggacccgtaacggtccccg

SEQ ID NO: 437889 - DNA, 593 bp, Homo sapiens
  misc_feature: GZ8MTXP02IB8BD.25.62.F07.1.454.CMB.2.raw
  modified_base (297)..(297): a, c, t, g, unknown or other
tcagactgtacagtcacgaccggtgctcgatttagtagtcgcataaagggaaagggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctatgataatatatctggactntaagaggccctgaggactccctgagcgtattctcgtggcctcgagccgacgagggacaacgtgtcactattcgaacatccatttcgggacttcccaacgtcccaggacggacgagggctacgtacgttattaacgtgtactaggtccaaggtacggacctccaacctactactcacgtcgtcggttcggcggaacggaccgaaggttcgaccgttccgacgttccgacgtacccgaacggtccttccgcccccgttcggacctaccgttcctcccgttccccgtcccctttacccg

SEQ ID NO: 437890 - DNA, 715 bp, Homo sapiens
  misc_feature: GZ8MTXP02FPZD4.25.62.F07.1.454.CMB.2.raw
  modified_base (266)..(266): a, c, t, g, unknown or other
  modified_base (294)..(294): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtgtccccaggacagacggccaggatcacctgctctggagatgtctttgccaacacaatatggttacnggtaccagcagaaggcggcaggcccctntattgataatatatctaggactcgtaaagacggcccttacgagggtactccccgtgacgcgtattctcgtcggcctccagcgcgaaggggaaccacgtgtacactattcgaacctatctagttcggtacgacccgtaagccccgtagggaaagggaccgaaagggtccgtaggtaaaccctttagtttaaccgtggttacgtaaaccggttagaaacggttaaccggaacccggaccccaaacccgtaaacctttaacccgaccgttaaacccgggttaccgtcccggggtttaccggggaaccggggtaaccgggtaaaacccgaaacggtcccggttaaccgggttaaacccccggtttccggtttaccggggtacccgtaaacccggggtaacccccggaaacccggtttcccccggg

SEQ ID NO: 437891 - DNA, 687 bp, Homo sapiens
  misc_feature: GZ8MTXP02F7FCN.25.62.F07.1.454.CMB.2.raw
  modified_base (281)..(281): a, c, t, g, unknown or other
tcagactgtacagtcacgaccggtgctcgatttagtagtcgcataaagggaaaggggggtccaggaggcagaactctgggtgtctcaccatggcctgggtccctctacttctcccccctcctcactctctgcacagggtctgaggcctcctatgaggtgacacagccaccctcggtgtcagtcgtccccaggacagacggccaggatcacctgctctgggagatgctttgaccaaacacaatatggttactggtaccagcaggaaggcggccaggcccctntatgataatatatctggactctaagacggccctgaggactccctgagcgtatttctctggacctccgacggccgaccgtagggaccaactgtaccactattcgacctaatcctagttacgacgtcccagcccgtggaacggacggtaggcgtaggtaccttattaaccgtgtacctagtactagaccggaccgcccaacccaccttactcccgtacggtccggtccgggtttccgggaccggggacggggtaaacccgaaacggtccgttaaccgggacccggttacccggtttacgggtcccgtaacggacccccggtaaccgggttacccgtccccggtacccccccggttacggggttacccctacccttcccggtttcccggtacccccccttaaacccccg

SEQ ID NO: 437892 - DNA, 660 bp, Homo sapiens
  misc_feature: GZ8MTXP02HOM5I.25.62.F07.1.454.CMB.2.raw
  modified_base (256)..(256): a, c, t, g, unknown or other
  modified_base (271)..(271): a, c, t, g, unknown or other
  modified_base (386)..(386): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagaccggccaggatcacctgctcgtggagatgtcttgaccaanacaatctaggttacngtaccagcaggacggccggccacggcccctgtatgacttaatatatctaggaactacgtaagacggcctacgacggggtactcccgtagcccgacgtatttcgcgtcggctccgngtcgacgacggggacaacttcgacacgtacttcgacctatacgtaagttcgggacttacccgagtcccgttaggaacgggacgacggtcttacgtactttacgttaactcggttacgacgttaccgaggttaaccgaccgaccctaacctacgttaacccgtacgtacccggtccggtaaccgggttcggggaccgggaacggggtacctaacgggtccggttaacgtacccggttacgttcggaaccgaccggtaccccgtaaggtcccccgg

SEQ ID NO: 437893 - DNA, 620 bp, Homo sapiens
  misc_feature: GZ8MTXP02HF84Q.25.62.F07.1.454.CMB.2.raw
  modified_base (301)..(301): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctcgtggagatgctttgaccaacacaatatggttactggtaccagcagaaggcggccacggcccctntattgataatatatctggtactacgtaagacgtccctacgagggtactccccgtgacgacgtattctcgttcggcctccgagccgcgaaggggaccaactcggtacacgtattcgaaccctatcagttaggactccgagtccgagacggacgaagggtctacggtaacctttagttacctgtaccgtaagttaccgaaggttaccggaaccccgaccctaacctactaccgtaccgtaccggtcggtaccggtacgggacgggaccgtacgacgtacgtaaccggtccgttacgtacgaccgaccgacccgtacgtccg

SEQ ID NO: 437894 - DNA, 672 bp, Homo sapiens
  misc_feature: GZ8MTXP02HPN64.25.62.F07.1.454.CMB.2.raw
  modified_base (301)..(301): a, c, t, g, unknown or other
  modified_base (367)..(367): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtcgtccccaggacagacggccaggatccacctgctctggagatgtctttgaccaacacaatatggttactggtaccagcagaaggcggccacggcccctntatgataatatatctagactacaagacgcctagaggactcccgtgaccgcgtattctcgtgcctcngcgacgaagggaacctacgtcgtcaaacgtacttacgaaccctattacgaagtttacggggtaccgttacccgaacggtccccgtaggggaaccggaacgggacggtccgttaaggtaaccttttaagtaccgttcgggtaccacgttacgaaggtacggaacccgtccccaaacctaaccttaccgtaccgtacccggtttcccggtacccggggtttacggggaccgggaaccgggaaccgtaaccggtccgtaaccggtacccgtccgtttaccgggctaacccggacccttacggtccccg

SEQ ID NO: 437895 - DNA, 506 bp, Homo sapiens
  misc_feature: GZ8MTXP02JQYR2.25.62.F07.1.454.CMB.2.raw
  modified_base (294)..(294): a, c, t, g, unknown or other
  modified_base (351)..(351): a, c, t, g, unknown or other
  modified_base (359)..(359): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntatgataatatatctggactctaagacggccctcgagggactccctgacgcgattcnctggctcngcgcagggacaactgtcacattcgaccatcattggatccagcctgaggacgaggctgactattactgtcagtcgagtagacgccacctactactcacgtcgcggttcggacggacggaccaagctgaccgtctggcacgccaagccg

SEQ ID NO: 437896 - DNA, 677 bp, Homo sapiens
  misc_feature: GZ8MTXP02GHGB3.25.62.F07.1.454.CMB.2.raw
  modified_base (239)..(239): a, c, t, g, unknown or other
  modified_base (293)..(293): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctgganatgctttgccaaacacaatatggttactggtaccagcagagcggccacgccctntatgataatatatctggactctaaagacgccctgagggtactcccgtagacgacgtattctcgtggccttccagcgccgaaggggaacctaacgtcgtacactaattcgaaccctatccaagtttggacgtcccgaagtcccgtaggaacgggaacgaacgggtcctaggtaaccttaagtttaccgttggtacccgtaagttccgaaagggtttaaccgaacccgtaccccaaacccgtaacctaccctaccggtaaccggttcccgggtaaccggtttcccggggacggggaacgggggtaaaccccaagggtcccgtaaccggtaaccccggttaccgtttcgggggaccctaaccggacccccggtaaaggttcccccgg

SEQ ID NO: 437897 - DNA, 716 bp, Homo sapiens
  misc_feature: GZ8MTXP02JKTU9.25.62.F07.1.454.CMB.2.raw
  modified_base (364)..(364): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctctattgataatatatctggactactaagacggccctgagggactccctgacgcgtattctcgtggctcngcgcagggacaacgtgtcacattcgaaccctatcgtagtttgggacgttcccaagtcccgtaggacggtacggaacgggtcgttacggaactttaacgtttaccgtagggttacctaacggttaccgtaacgggttaaccggaacccggaccccgtaaacccgtaaaccttaaccccgttacccggtaaacccgggtttcccgggtaaacccggggttttcccgggggacccgggggtaaaccgggggtaaaaccccgtaaaacgggcccggttaaccgggtaaacccccggtttcccggtttacgggggttaccccgtaaccgggtacccccggaaacgggttccccccgg

SEQ ID NO: 437898 - DNA, 514 bp, Homo sapiens
  misc_feature: GZ8MTXP02GMETJ.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctctattgataatatatctggactctaagaggccctcagggatcccctgacgcgattctctggctccagcgcagggacaactgtcacattgaccatcattggagtccagcctgagacgagctgacttatactgtcagtcagtagacgccaccactactcacgtcgtcgttcggcggacggaccaagctcgacccgttacgtcggtcacgacccaaggtcccg

SEQ ID NO: 437899 - DNA, 579 bp, Homo sapiens
  misc_feature: GZ8MTXP02J2VU1.25.62.F07.1.454.CMB.2.raw
  modified_base (296)..(296): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccacggcccctntatgataatatatctggactcgtaagcggccctgagggtactcccgtgaccgcgtattccgtctggccttccgagccgacgacggggacctaacgtgttaccactatttcgaaccctatacctaggttacggacgtccgaaggtccctagggacggacgagggtctacggacttattacgtggttacagtcaaggtacgaccgaccaaccacgtactcgacgttcgcggtacggcggacgacctaagcgtcgtacccgtcgttacgacacgacccgagtcccg

SEQ ID NO: 437900 - DNA, 650 bp, Homo sapiens
  misc_feature: GZ8MTXP02FQ90N.25.62.F07.1.454.CMB.2.raw
  modified_base (239)..(239): a, c, t, g, unknown or other
  modified_base (252)..(252): a, c, t, g, unknown or other
  modified_base (294)..(294): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcactgctctgganatgctttgccaanacaatatggttactggtaccagcagaaggcggcaggcccctntattgataatatatctaggactctaaaggacggtccctacgaggggtactccccgtaggaccgtcgactttctcgttcggccttaccgaggccgacgaacgggggaacctaaaccgttggttacaaaccctaatttcggaaaccctaattacctaagtttcgggaacgttcccaaaggtccccgttagggaacgggaccgtaggacgtacggaaccgtttatttaaccgtggttaccaagttaccgaagttacgaccgacccaaacctaactaccctaccacggtccgtacgttccgggacggtaacgggacgaaggaccgtaacgacccgtcgttacgcacggcccaaaggtccc

SEQ ID NO: 437901 - DNA, 703 bp, Homo sapiens
  misc_feature: GZ8MTXP02F4OMN.25.62.F07.1.454.CMB.2.raw
  modified_base (304)..(304): a, c, t, g, unknown or other
tcagactgtacagtcacgaccggtgctcgatttagtagtcgcataaagggaaagggggggagcctagctgtgctgtgtgtccaggaggcagaactctgggtgtctcaccatggcctgggtccctctacttctcccctcctcactctctgcacagggtctgaggcctcctatgaggtgacacagcccaccctcggtgtcagtcgtccccaggacagaccggccaggactcacctgctctggagatgctttgaccaaacacaatagtggttactggtaccagcaggaacggcggccacggcccctntatgaataatatatctggactctaaaggacggtccctagaggtactcccgtgacgacgtattcctcgtcggcctccgagccggacgaaggggacctaaacgtcgtaccaactagttaccgaaccctataccgaagtttacggaccgttacccgaaggtcccgtaggggacgggtaaccgggaggtaccgttaggtaacctttaactttaaccgttgtaccctaagttaccgtaaaggttaaccggaccgtaaccccaacccgtaaccttaaacccgtccgtaaccgggtcccgggttaccggttacccggggaccggggtaaaccggggacccaaacggccgttaccgtaaccccgggtttccgttccgggtaccaacccgggacccccgtaaaccggg

SEQ ID NO: 437902 - DNA, 539 bp, Homo sapiens
  misc_feature: GZ8MTXP02I3ORE.25.62.F07.1.454.CMB.2.raw
  modified_base (328)..(328): a, c, t, g, unknown or other
  modified_base (359)..(359): a, c, t, g, unknown or other
  modified_base (362)..(362): a, c, t, g, unknown or other
  modified_base (376)..(376): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaggcggccacggcccctctattgataatatatctggactctaagcgccctnagggtatccctgacgcgattctactggctcngcncagggacaatgcanttgaccatcagttgacgtctacgctagagacgagctagacttatatgtacagtcagtagctaccacaacgtctaccgacggtccgtccggttcggaccgggacggaacccagaccgtcggacccgttccgttaacgggccacggaccccgtaaacggtccccg

SEQ ID NO: 437903 - DNA, 725 bp, Homo sapiens
  misc_feature: GZ8MTXP02GWWML.25.62.F07.1.454.CMB.2.raw
  modified_base (239)..(239): a, c, t, g, unknown or other
  modified_base (244)..(244): a, c, t, g, unknown or other
  modified_base (303)..(303): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctctcactctctgcacagggtctgaggcctcctatgaggtgacacagcccacccgtcggtgtcagtcgtccccaggacagacggccaggatcacctgcctntgganatgtcttgaccaacacaatatggttactggtaccagcaaggaaggcggcacggcccctntatgaataatatatcgtggtactactaaaggcggccctagagggactcccgtagaccgacgtattctcgtacggtcctccgacggccgacgtaaggggaaccctaaacgtcgtacctaacctagttacgaaccctatacgtaagttcgggaactccgacgacccgtaggaacggacggacggcctaggtaacctttattaaccgttgggtactaacgttaccgaaggttaaaccggaccgtaaccccaaacccgttaacctaaccggtacccgttaaaccgggttcccgggtccgggttacccgggggacggggtaaaccgggggtaaccccaaacggtcccggtaaccggttaacccccggtttcccggggtttacggtaccccggtaaaccggtacccccgggtaaaacggggtcccccg

SEQ ID NO: 437904 - DNA, 546 bp, Homo sapiens
  misc_feature: GZ8MTXP02JRORX.25.62.F07.1.454.CMB.2.raw
  modified_base (441)..(441): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacgccaggatcacctgctctggagatgctttgaccaacacaatatggttactggtaccagacaggaacggcgggccacggcccctgtacttagataatatactctaggactctaagacggccctgagggtactccccgtgaccgtcgtattcgtctggtccaccaggcgacgaacgggaccaatcgtcacgtatcgaccatcattggactccagctgacgacgaggntagacttagtactgtcagtcagtacgacaccacactactcgacgtcgcgtcggacggacgacgaagctaacgtacgtacgttcggaccacgaccgtacggtcccg

SEQ ID NO: 437905 - DNA, 757 bp, Homo sapiens
  misc_feature: GZ8MTXP02IGYSS.25.62.F07.1.454.CMB.2.raw
  modified_base (243)..(243): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttcctccccctcctcactctctgcacagggtctgaggcctcctatgaggtgacacacgccacccgtcggtgtcagtcgtccccaggacagacgccaggatcacctgctctggagntgctttgaccaacactaatatggttactgtaccagcaggaacggcggccacggcccctacgtattagaattaaatataacttcgtaggaccttacgtaaaacggaccggtccccgtacgtaacggggtaaccttccccgttaggaccgtacccggttacttttcccgttaccggttcgggttccccgttacccgacgggacccggtaccggtaaacgggggaaacccccttaaaccgttccgggttaaccgtaaaccctacgttttaccggaaccccttaaattccgtaaaggttttaccgggaacgttcccccgtaagtcccgtagggaaacgggtacgacgggttactacggtaacctttagttaaccgtttgacgtacggttacctaaggtacgaccgtaccaacctacgtacctacgtacgtcggtacgttaccgggacgggacgtaaaccgagtcccggtaacgtaacccccgttgttcgggaccctaccggaccgaacggttcccccg

SEQ ID NO: 437906 - DNA, 756 bp, Homo sapiens
  misc_feature: GZ8MTXP02FVYC1.25.62.F07.1.454.CMB.2.raw
tcagactgtacagtcacgaccggtgctcgatttagtagtcgcataaagggaaaggggggtccaggaggcagaactctgggtgtctcaccatggcctgggtccctctacttctccccctcctcactctctgcacagggtctgaggcctcctatgaggtgacacagccaccctcggtgtcagtcgtccccaggacaggacggccaggatcacctgctctggagatgctttgaccaaacaactaattagttggttaactcgggtaccagacgaaggaaacgggccggccgacggcccccttatattagaataatattatccgtggaactacgtaaagcggcctacgaggactcccgtgacgcgtatctctgcctaccgagcccgacgacgggaactaacgtgtaccacgtagtacaaccctattccgatttggggaccttacccgagtacccgtaggaacgggtaacgacggacgttacgaacctttaagttaccgtaggtacctagtaccggtaaataaccgggaacccgtacccaaacccgtaacttaaccgttacccgaaccggttaccggtcccggggtttacggggaccgggtaaacggggacccgaaacggtccgttaacggtaccccggtttcggtttacgggaccgtacccgggtaaacccgacggttaccccggtaaccccgtccccccgggttccgggttaaccctaccccggtttccgttccccgggttttaccccccccgtaccccg

SEQ ID NO: 437907 - DNA, 655 bp, Homo sapiens
  misc_feature: GZ8MTXP02JXJTN.25.62.F07.1.454.CMB.2.raw
  modified_base (239)..(239): a, c, t, g, unknown or other
  modified_base (252)..(252): a, c, t, g, unknown or other
  modified_base (301)..(301): a, c, t, g, unknown or other
  modified_base (380)..(380): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcactgctctgganatgctttgccaanacaatagtggttactggtaccagcaaggaacggcggaccacggcccctntattgataatatatctaggactacgtaaagcggtccctcgagggtactcccgtgaccgtcgtacttctcgtggcctcgngcgcgaggacaagtgtacactattcgaacctatacgtagtttagggactaccgacggacccgtaggaccgggaacggtacgggtactaacggtaacctttaacgttaacgttcgttaccgaagttaccgacggttaacggaccctaccaacccgtaactaacccgttccgtaaccgggtaccggttccgggtacggggaccgggaaacggacccgttaacgccgtaaccggtaccccgttaccgttcggaccgaaccggtacccgaacggtcccg

SEQ ID NO: 437908 - DNA, 703 bp, Homo sapiens
  misc_feature: GZ8MTXP02J1GNS.25.62.F07.1.454.CMB.2.raw
  modified_base (301)..(301): a, c, t, g, unknown or other
  modified_base (376)..(376): a, c, t, g, unknown or other
tcagactgtacagtcacgaccggtgctcgatttagtagtcgcataaagggaaagggggggaggcctagctgtgctgtgggtccaggaggcagaactctgggtgtctcaccatggcctgggtccctctacttcctccccctcctcactctctgcacagggtctgaggcctcctatgaggtgacacagccaccctcggtgtcagtgtcccaggacagacggccaggatcacctgctctggagatgtctttgaccaacacaatatggttactggtaccagcaggaaggccgaccacggcccctntattgaataatatatctaggactcaaggacgccctagacggactcccgtagacgtcgtattcgtcgtgcctccgngcgacgaggaccaacgtgtacactattacgacctatctagttgggactccgaaacggtccctagggaacgaccggaaggtccgttacggtaccttaacgtttaccgtacgggttaccacggttaccggaacggttaaccggtaaccccgacccctaaaccctaccggttaaccctacccggtaacccggtttcccggggtaccggggtttaaccggggacccggggtaaaccgggggaaacccctaacggtacccggttaaccgggtaccccggtttaccggtttccgggtacccgaacccggtaaccccggtaccgggttcccccg

SEQ ID NO: 437909 - DNA, 681 bp, Homo sapiens
  misc_feature: GZ8MTXP02GBB5S.25.62.F07.1.454.CMB.2.raw
  modified_base (242)..(242): a, c, t, g, unknown or other
  modified_base (299)..(299): a, c, t, g, unknown or other
  modified_base (311)..(311): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcaggtcgtccccaggacagacggccaggatcacctgctctgganatgctttgaccaacacaatatggttactggtaccagcagaaggcggccaggcccctntattgataagtntatctggactctaagcgcctgacggatcccgagacgcgtactttctacgtggccttaccacggccgacggtaacggggacctaaacgtcgtaccaactaacgtttacggaaaccctaattaccgtaagtttacggggtaacgttaccccgaaacgtccccgtaagggaaacggggtaccggaaacgggtacgttaacggtaacccgtttaatttaacccgtaggttacctacgtaccgtaagtaacggaccgacccaacctactaacctaccgaaccggtccgtaccgggtttaccggacggggtacggaaacccgaacgtccgtaaccggtaccgttaccgttcgggtaccacggacccgacgtacccg

SEQ ID NO: 437910 - DNA, 536 bp, Homo sapiens
  misc_feature: GZ8MTXP02GQKH3.25.62.F07.1.454.CMB.2.raw
  modified_base (296)..(296): a, c, t, g, unknown or other
  modified_base (368)..(368): a, c, t, g, unknown or other
  modified_base (448)..(448): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaacacaatatggttactggtaccagcagaaggcggccaggcccctntattgataatatatctggactctaagcggccctcgagggactccccgtgacgcgtattctctggccttccgngccgcgagggaccaactgtcactagttcgaccatctagttgacgtccctagccgtaggaggacgaggctgtactattacngtacagtcagtacgacgccaccgactactcacgtcgcgtcggcggacgggacaagctaagacccgtcgtcggtcacgtccgacgtccg

SEQ ID NO: 437911 - DNA, 536 bp, Homo sapiens
  misc_feature: GZ8MTXP02GGAR8.25.62.F07.1.454.CMB.2.raw
  modified_base (367)..(367): a, c, t, g, unknown or other
  modified_base (388)..(388): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaacggcggccacggcccctctattgataatatatctggactctaagacggccctcgagggactcccgtgacgcgtattctcgtgcctccngcgcgagggacaactgtacanattgaccatcattggactccagcctgacggacgaggctgacttattactgtacagtcagtacgacgaccaaccactactcgacgtcgacggttcggacgggacggacccaagctaacgacccgtcgttggtccacgacccgaggtccc

SEQ ID NO: 437912 - DNA, 652 bp, Homo sapiens
  misc_feature: GZ8MTXP02IO61L.25.62.F07.1.454.CMB.2.raw
  modified_base (519)..(519): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacacgccaccctcggtatcagtcgtccccgaggacagacggccaggactcacctgctcgtggagatcgtctttcgaccaaacaacaattataggttactcggtacagacaggaacggcggaccgacggcccctattacttagaattaactatatacgtagactacgtaaggacgtccctagacggtactccgtagtaccgacgtacttctcgtacggtccgtaccgcgcgacggaacgggaacctacgtcgtacacgtacttcgacctatcgtagttcgaacgtcacgtccgtggacgacggacgtaccttaggtactttaagtttcgtcggtaacngttacgaagtacgacccgacctaccctaaacgttcacggtaccggttcggtcccggggttaacgggcgggtaaacgggacccaaaggtcctaacggtcccgttacgtcggaacccacgtacccggcgtccccg

SEQ ID NO: 437913 - DNA, 750 bp, Homo sapiens
  misc_feature: GZ8MTXP02JAJRS.25.62.F07.1.454.CMB.2.raw
  modified_base (239)..(239): a, c, t, g, unknown or other
  modified_base (260)..(260): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctgganatgtctttgaccaacacaatntggttactggtaccagcagaaggcggtccacggcccctactattgataaagtatatcgtaggtactcgttaaagacggtacccttacgacggggtactccccgtaggaaccgtaccgtactttcgtcgttcgggacccttccgacgggccgacggaaacggggtaccaaacgttcggtaaccctaacgtaatttacggaaaccctaagttccgtaaaggtttcgggaaacgttccccgaggacccgttaagggaacgggtaacggacgggtacccgttaggtaaacccgtttaattaacccgtgggttaacctacggttacgaacggttaaccgaacccggtacccaaacccgaacgtttaccaccggtaaccggttaccggtccgggtttaaccgggggacgggtaaccgggggaaacccttaggaacccgttcgggtaacccgtttccggttcggtaaccgacccggtaccccgaacgggttcccccg

SEQ ID NO: 437914 - DNA, 672 bp, Homo sapiens
  misc_feature: GZ8MTXP02JYY8C.25.62.F07.1.454.CMB.2.raw
  modified_base (299)..(299): a, c, t, g, unknown or other
  modified_base (375)..(375): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctactactccccctcctcactctctgcacagggtctgaggcctcctatgaggtgacacagccaccctcggtgtcagtcgtccccaggacagacggccaggatcacctgctctggagatgctttgaccaacacaatatggttactggtaccagcaggacggcggccacggcccctntattgataatatatctggactacgtaaggcgccctgacggactcccgtagaccgtcgattccgtcgtcggcctcgnggccgacgaacggggacaacgtgtacctaacgactttccgaaccctaagttacgtaaggtttacgggaccgttacccggaacggtccccggttaaggggacgggggaacgtacggggacctttacgggtaaacctttagttaaacccttgggtaacctacgttaccgaacggtaacgacccgtcccaacctacctaacgttcccgaacggttccggtaccgggttaccggggacggaacggaccgtagccgtaaccggtcccgttacgtcggacgaccgaacccggacggttccccg

SEQ ID NO: 437915 - DNA, 766 bp, Homo sapiens
  misc_feature: GZ8MTXP02F7X9T.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagcccaccctcggtgtcagtcgtccccaggacagacggccaggatcacctgctctggagatgtctttcgaccaaacacaattagttggttaactcggtaaccagacgaggaacgggcggaccgtacggcccctactattagtaattaaattataatcgtaggtaaccttacgtaaagacggtcccctacggtacgggtactccccgtaggacgtccgtactttcgcgttacggccttaccggaggccgacggaaaggggtaaccctaacgttacggtaccaactaaacggtttcaaacccttaataccgttaggtttaagggtaaccgttacccgacggtaccggttagggaaaccgggacgggaaaccgggtcgttaacggtaaacctttaagtttacccttacgggttaccgtagtaccgtaacggttaaccgaaccccgttacccaacccaaaccgtttaccgtaccggtaaaccggttcccggtaacgggggtttccggaaccggggtaacgaaacccggaacgtccgtaacggtaccccgttcgtaccggtaccggaaccgtacccgaacggtccccg

SEQ ID NO: 437916 - DNA, 668 bp, Homo sapiens
  misc_feature: GZ8MTXP02G81JE.25.62.F07.1.454.CMB.2.raw
  modified_base (308)..(308): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacacgcccacccgtcggtgtcagtcgtcccaggacagacggcaggatccacctgctcgtggagtatgtcttgacccaacactaatatggttactcggtaccagcgaggaaggcggacacggccctntatagatatatatcgtaggactactaagcggccctagagggtactccgtgaccgtcgtattcgtcgtcggtcctcgacggcgacgacggggtaaccaactacgtcaaaccgtattacgaaccctatacgtaagtcggtactacccgacgtcgacggaagggacgtacgggattacgggaactttaaacttcggttacgtacgtaacgttacgaaaggttaccgaccacccaaacccgtaacctaccgttaaccgtacggttacccgggtcggttaccggggaccggggtaacggaacccgaaacgtcgtaacccggttaccgttcggttacgacggacccgtaccgtaacgggtcccccg

SEQ ID NO: 437917 - DNA, 574 bp, Homo sapiens
  misc_feature: GZ8MTXP02JLPYM.25.62.F07.1.454.CMB.2.raw
  modified_base (240)..(240): a, c, t, g, unknown or other
  modified_base (300)..(300): a, c, t, g, unknown or other
  modified_base (315)..(315): a, c, t, g, unknown or other
  modified_base (320)..(320): a, c, t, g, unknown or other
  modified_base (364)..(364): a, c, t, g, unknown or other
  modified_base (404)..(404): a, c, t, g, unknown or other
  modified_base (467)..(467): a, c, t, g, unknown or other
  modified_base (472)..(472): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctctcactctctgcacagggtctgaggcctcctatgaggtgacacagccaccctcggtgtcagtcgtcccaggacagacggccaggactcacctgctcgtgganatgtctttagacctaacacaatatggttactggtaccagcagaaggcggccaggcccctntatgattatatatcngactntaggcgcctgcgggatcccgtgacgcgtattctactcggctccngcgcgtacgggacaacgtgtacactagtcgaaacccgtancctagtttgggaccttccgagtcccgtagacggcggagtccgtagacgttattaccgtgtacngttanacggttagaccgcctacgactactacgtacgcgtacggttcgggacggtacggacctaacgctccggaccgttccgttaggtaccacggtaccgtacggccc

SEQ ID NO: 437918 - DNA, 612 bp, Homo sapiens
  misc_feature: GZ8MTXP02GWIZ4.25.62.F07.1.454.CMB.2.raw
  modified_base (239)..(239): a, c, t, g, unknown or other
  modified_base (267)..(267): a, c, t, g, unknown or other
  modified_base (377)..(377): a, c, t, g, unknown or other
  modified_base (508)..(508): a, c, t, g, unknown or other
  modified_base (525)..(525): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacgccaggatcacctgctctgganatgtctttgaccaacacaatatgttacnggtaccagcaggaaggccggaccacggccccctatattgaattaaatatatctaggacttcgtaagacgccctcgagggtactccctgaacgcgtattctatcggcctcnggccaggacgggacctaacgtgtacaactagttcgaacccttatactagtttaggacttcccgaagtcccgtaggacggaacggtaggtcctagtaacttattaccgttggacctagtaccaggtacgacnccaacgactaactaccncggttcggcggttaccgggcgggaacgggacccaaggtcctcggtacccgttacggtttcggaccacggaccccgtaacggtccccg

SEQ ID NO: 437919 - DNA, 522 bp, Homo sapiens
  misc_feature: GZ8MTXP02GXC7H.25.62.F07.1.454.CMB.2.raw
  modified_base (253)..(253): a, c, t, g, unknown or other
  modified_base (296)..(296): a, c, t, g, unknown or other
  modified_base (363)..(363): a, c, t, g, unknown or other
  modified_base (384)..(384): a, c, t, g, unknown or other
  modified_base (435)..(435): a, c, t, g, unknown or other
  modified_base (441)..(441): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtccccaggacagacggccaggatcacctgctctggagatgctttgccaanacaatatggttactggtaccagcagaaggcggccaggcccctntatgataatatatctggactcgtaagacggccctgagggactcccgtgacgcgattctcgtgcctcngccgacagggacaactgtcanacttgaccatcattgatccagcctagagacgaggctagacttatactgtanacgttnagtagacgaccacctataactcacgtcgcgttcggacgacgggaccaagctaagacctcgttggcacgccgaacggtcccg

SEQ ID NO: 437920 - DNA, 596 bp, Homo sapiens
  misc_feature: GZ8MTXP02IIAXS.25.62.F07.1.454.CMB.2.raw
  modified_base (299)..(299): a, c, t, g, unknown or other
  modified_base (400)..(400): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtcgtcccaggacagacggccaggatcacctgctctggagatgctttgccaaacactaagtatggttactggtaccagcagaaggcggaccaggcccctntattagataaatatatctgactctaagacgtcctacgaggtactccgtgacgcgtactctcgtgcctccgacgcgcgacgggacacgtacgtcacacttanacctatactattgaacgtcaacgtccgtacgaggacggaacggcgtacgtacttagttaaccttgtacgtaccgttacgtaagtacggaccgaccctaccaacctaacctcctaaccgtaccgtaccggttccgggacgggacgggaaccgaacgacgtcgtaccgtacgttcgttacgaccgaccgaacgtcccg

SEQ ID NO: 437921 - DNA, 633 bp, Homo sapiens
  misc_feature: GZ8MTXP02I6G07.25.62.F07.1.454.CMB.2.raw
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctctggagatgtctttgacccaacactaatataggtttactggtaccagcaaggaacggcggaccacggcccctactattagataatatatcgtgactacgtaagacggtccctacgaacgggtactccgtaggacgaccgtattcctcgtcggacctccgacgcgacgaacgggacctaacgtgtaccaacgtattaccgaacattacagttgaccttccgaagtccgtaggaacgggacgaacggtcctaaggacctttaagtaccgttagaccgtagtaccgtaacgtacgacgaacccctactaaccgtacgtcccgaggtacccgtcgggtacgggacggacgtaacgacgtccgaagttacccgtcgttacgcgaccgtaccgagttccccg

SEQ ID NO: 437922 - DNA, 524 bp, Homo sapiens
  misc_feature: GZ8MTXP02GSCNE.25.62.F07.1.454.CMB.2.raw
  modified_base (253)..(253): a, c, t, g, unknown or other
  modified_base (297)..(297): a, c, t, g, unknown or other
  modified_base (351)..(351): a, c, t, g, unknown or other
  modified_base (449)..(449): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaanacaaatatggtactggtaccagcaggaaggcggccaggcccctntattgataatatatctggactctaagaggccctgaggatccctgacgcgattcnctggctccagcgacagggacaactgtacactattcgacatcattggactccagccctagagacgagctagacttatactgtacagtcagtacggaccncccaacctactactacgaccgtcgtcgtcggacggaggaccagctcgaccgttcttcggcacgacccaaggtccc

SEQ ID NO: 437923 - DNA, 609 bp, Homo sapiens
  misc_feature: GZ8MTXP02JPQRL.25.62.F07.1.454.CMB.2.raw
  modified_base (275)..(275): a, c, t, g, unknown or other
  modified_base (367)..(367): a, c, t, g, unknown or other
tcagactgtacagtcacgaccggtgctcgatttagtagtcgcataaagggaaaggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtccagtcgtccccaggacagacggccaggatcacctgcctctggagatgctttgaccaacacaatatggttactggtaccngcagaaggtcggaccacggccctctatgataatatatctaggactcgtaagacgccctcgaggactccgtgacgtcgattctcgtggcctcngcgacgagggtacaacgttgacactagttcaacctataccgtatttcggggaacttccccggaagcccgtaggaaacggaccgttaggggcccttaggtaaccctttagttaacccgtcgggttaaacgacggtacgaacggtacgacccgtaccaaccgtactaccgtacgtacggtcgtacgggtcggacggacgaccagccgtaacgtccgttacgtcggaccaccgtaccgacggtcc

SEQ ID NO: 437924 - DNA, 736 bp, Homo sapiens
  misc_feature: GZ8MTXP02I42ZO.25.62.F07.1.454.CMB.2.raw
tcagactgtacagtcacgaccggtgctcgatttagtagtcgcataaaagggaaagggggggagcctagctgtgctgtgggtccaggaggcagaactctgggtgtctcaccatggcctgggtccctctacttctccccctcctcactctctgcacagggtctgaggcctcctatgaggtgacacagcccaccctcggtgtcagtcgtccccaggacagaccggccaggatcacctgctcgtggagatgtctttgaccaaacactaattagtcggttactacggtaccagcgaggaaggtccggccacggcccctactaatttgaaattaagtatactcgtaggacttacgtaaacggccggacccttacggaaacgggtccttacccgtgtaacccgcgtaattccgtcgtcggccttccgcggacgcgaaaggggacctaacgtcgtaccaacgtacgttacgtaaccctaacgttaacgtacgttacgggtaactcccctaagccccggttaggggaacggaaccggtaaacggtccgtttaaacgggaaactttttaacggttacctttgggtaacctaaccggttaagaacggttaacggaacccgtaccaacccgtaacctacccgtaccggtacgggtcccgtaccggggttacgggacgggacccgggaacgtaacccggtcgtaaacggtcccgttcgttacggcccgacggtacccgtacgtccccgg

SEQ ID NO: 437925 - DNA, 712 bp, Homo sapiens
  misc_feature: GZ8MTXP02G8UNJ.25.62.F07.1.454.CMB.2.raw
tcagactgtacagtcacgaccggtgctcgatttagtagtcgcataaagggaaagggggggagcctagctgtgctgtgggtccaggaggcagaactctgggtgtctcaccatggcctgggtccctctacttctccccctcctcactctctgcacagggtctgaggcctctatgaggtgacacagccaccctcggtgtcagtcgtccccaggacagacggccaggatcactgctctggagatgtctttgaccaacactaatataggttactggtaccgagcaggaacggccggccacggcccctactattgaataatatatcgtggtactagtaagacggtccctagaggtactccgtagacgtcgtacttctcgtcggcctaccgacgccgacgaacgggaacctaacgtcgtacctactattaccgaacctatactacgtttacgggacgttcccgacggtccgtacgggaaccgggtaacggacgggtaccgtaaggtaacctttaaagtttaccgttacgttaacgtacgttacgtaacggttaccggtaacccgaccccgtaacccgtaaccgttaacccgtacccggtaacccggttccggtaccggggttacccgggaccggggtaaccgggaacccgaaccggtaccgtaaccggtacccgttaccggtttaccggaccgtaaccgaccccggtaacgtcccccgg

SEQ ID NO: 437926 - DNA, 599 bp, Homo sapiens
  misc_feature: GZ8MTXP02JT14U.25.62.F07.1.454.CMB.2.raw
  modified_base (243)..(243): a, c, t, g, unknown or other
  modified_base (423)..(423): a, c, t, g, unknown or other
  modified_base (435)..(435): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttcctccccctcctcactctctgcacagggtctgaggcctcctatgaggtgacacagcccaccctcggtgtcagtcgtccccaggacagacggccaggatcacctgctctgganatgctttcgaccaacacaatatggttactggtaccagacaggaacgggccgggaccacgggcccctacttagttcgaattaatatactcgtaggacttactaaacggacggtcccttcgaaggggtcctcccgtagaccgcgtacttctcgtcggctcgacgcgacgacgggacaacgtntacatatacacntcgtagtgacgtcacgcgtaggacgacgacgtacgtacgtacttatcgtacgtactacgtacgacgacaccgaccacctacgtacctacgtacggtcggtcgtacgggacgggaccgacgtacgaccgtccgtaccgttcgtcggaccgaccggccgacgtccg

SEQ ID NO: 437927 - DNA, 711 bp, Homo sapiens
  misc_feature: GZ8MTXP02FM9PN.25.62.F07.1.454.CMB.2.raw
  modified_base (239)..(239): a, c, t, g, unknown or other
  modified_base (266)..(266): a, c, t, g, unknown or other
  modified_base (295)..(295): a, c, t, g, unknown or other
  modified_base (336)..(336): a, c, t, g, unknown or other
tcagactgtacagtcacgaccggtgctcgatttagtagtcgcataaagggaaagggggggagcctagctgtgctgtgggtccaggaggcagaactctgggtgtctcaccatggcctgggtccctctacttctcccctcctcactctctgcacagggtctgaggcctcctatgaggtgacacagccaccctcggtgtcagtcgtccccaggacagacggccaggatcacctgctctgganatgtcttgccaacacaatatggttacnggtaccagcagaaggcggccaggcccctntattgataatatatctggtactacgtaaagacggcccctanacggggactccccgtagaccgtccgtaactttctcgttcggccttccacgggccgacgtaaggggaaacctaaacgttcggtaccaacctagtttacgaaccctaagtccaaagtttcgggaacgtcccgtaagccccgttaggaaacgggtacggaaagggccttaaggtaaccgttaatttacccgttaggttaccaacgggtttacctaaggtaacggacccgaacccttaccgaaaccttaacctcctaaccggtaccgtccgggtttaaacgggccgggtaaccgggggaaccaaacggggtccctaaccgggtaaaccccgtttccggttaacggggtcccaacgtaccccggaaaacggggtcccccg

SEQ ID NO: 437928 - DNA, 808 bp, Homo sapiens
  misc_feature: GZ8MTXP02GB1NL.25.62.F07.1.454.CMB.2.raw
  modified_base (243)..(243): a, c, t, g, unknown or other
  modified_base (305)..(305): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctacttctccccctcctcactctctgcacagggtctgaggcctcctatgaggtgacacacgccaccctcggtgtcagtcgtccccaggacagacggccaggactcacctgctctgganatgtcttgaccaacacaatatggttactggtaccagcgaggaacggcggaccacggcccctntatgataatatactctaggtactacgtaagacggtccctaggacgggtactccccgtggaccgcgtacttccgtacgtcggtcctccgacggccgacggaaacgggggacctaaacgttcggtacccaagttagtacccggtaaccctaattcccgtaaaggttttcggggaacctcccggtaaacgtcccggtacgggaaacgggtacgggaaacgggttcccttaagggtaacccttttaacgtttaccgttacgggtacctaaacggttaccgtaaagggttaaccgggaaacccccgtaccccgaaaccccgtaactttaaccccgttaacccggtaaaccggtttaccccggggttccgggggtttaaccgggggaacccgggggtaaccggggaaaaccccgtaacggttacccggttaacccggggtttaaacccggttcccggttttaccgggaccccgtaaaccggtacccccgggaaacggggtttccccccg

SEQ ID NO: 437929 - DNA, 576 bp, Homo sapiens
  misc_feature: GZ8MTXP02I5YD7.25.62.F07.1.454.CMB.2.raw
  modified_base (305)..(305): a, c, t, g, unknown or other
tcagactgtacagtcacgaccggtgctcgatttagtagtcgcataaaggggaaaggggggggagcctagctgtgctgtgggtccaggaggcagaactctgggtgtctcaccatggcctgggtccctctacttcctccccctctcactctctgcacagggtctgaggcctcctatgaggtgacacagccaccctcggtgtcagtcgtcccaggacagacggccaggatcacctgctcgtggagatgtctttgaccaaacacaatagtggttactggtaccagcaggaaggcggaccacggcccctntattgataatatatctggactcgtaagcggccctagacggctaccctgacgctattctcgtcggcctacgagccgacgaacggggaccaacgttcggaccaactacgttcgaaccctatacgtagttgggactcaacgcctagggacgacgagcctagtacttatacgtgtactagtcagtacgacaccacactatccgacgttcgacggtacggcggaacggaccaacgcgtaacggcccgttacgtacggctacggcccgaagtccccg

SEQ ID NO: 437930 - DNA, 673 bp, Homo sapiens
  misc_feature: GZ8MTXP02FH4WT.25.62.F07.1.454.CMB.2.raw
  modified_base (200)..(200): a, c, t, g, unknown or other
  modified_base (244)..(244): a, c, t, g, unknown or other
  modified_base (268)..(268): a, c, t, g, unknown or other
  modified_base (307)..(307): a, c, t, g, unknown or other
tcagactgtacagtcacgaccggtgctcgatttagtagtcgcataaagggaaaggggggggagcctagctgtgctgtgggtccaggaggcagaactctgggtgtctcaccatggcctgggtccctctaccttctccccctcctcactctctgcacagggtctgaggcctcctatggaggtgacacagcccaccctcggtntcagtcgtccccaggacagacggctaggatcacctgctctgganatgtctttgacccaaacacaaatntaggttactggtaccagcagaaggcggccacggcccctntattgataactatatcgtaggacctactaaaggacggtcccctcgaggggactccccgtaggaccgtccgtattctcgtcggaccctcgagcgacgaacgggtaccaaacgttcgacaacctatttacgaaccctatactaattggggtaaaccctaccgaggtacccgtagggaaccgggacggtacggaccgttacgttaaccttaacgttacgttacgtacgtacgttaacgaacggtaaccgacccgaaccctaaccctaccgtaaccgtccgtaccggtcggtccggtacgggacggaaccgggtaaccacgtcgtaaccggtaccgttacgttcggacctaccggacccgtacggtcccg

SEQ ID NO: 437931 - DNA, 580 bp, Homo sapiens
  misc_feature: GZ8MTXP02I8ZLQ.25.62.F07.1.454.CMB.2.raw
  modified_base (275)..(275): a, c, t, g, unknown or other
  modified_base (366)..(366): a, c, t, g, unknown or other
tcagactgtacagtcacgaccggtgctcgatttagtagtcgcataaagggaaaggggggtccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcggccaggcccctntattgataatatatctggactctaagcggccctcagggactccctgagcgattctctggctccgagccgcgagggacaacgtcgtacactnttcgaaccattccagttgggactccgacgccgtggaggacggaggcgtagtacttattacgtagtactagtacgtagtaacgacgccaccctactacctcaccgtcgtcggttcggacggtacgggaccgaagcgtacgtaccgtccgttaggtcacgacccgaaggtccgtccgtcccccgtcggtccaccgttccgtccgttccccgtcccc

SEQ ID NO: 437932 - DNA, 521 bp, Homo sapiens
  misc_feature: GZ8MTXP01C2LMV.21.23.C01.1.454.CMB.2.raw
  modified_base (352)..(352): a, c, t, g, unknown or other
  modified_base (410)..(410): a, c, t, g, unknown or other
  modified_base (445)..(445): a, c, t, g, unknown or other
  modified_base (461)..(461): a, c, t, g, unknown or other
  modified_base (465)..(465): a, c, t, g, unknown or other
  modified_base (471)..(471): a, c, t, g, unknown or other
  modified_base (473)..(473): a, c, t, g, unknown or other
  modified_base (514)..(514): a, c, t, g, unknown or other
tcagtcgtcgctcgcacgaccggtgctcgatttagtacacgtgattagggattggggcccagccctgggattcccagctgtttctgcttgctgatcaggactgcacacagagaactcaccatggagtttgtgctgagcgtggttttccttgttagctatttaaaggtgtccagtgtgaggtgcagctggtggagtccggggaggcttagttcagccgtgggggtccctgagactctcctgtgcagcctctggattcaccttcagtagctactggatgcactgggtccgcaagctccgaggggaaggggctgggtgtggggtctcacgtattaatagtgatggggactagcanaagctaaacgcggaactcgtgaagggcgatcacatctcagagacaacgccaaagaacncgactgtaatctagacaaatagaacagttcagagngccgaaggcacgggtntgtntaatcngngacgaacggcccaagacagaactacgcagtcggacgtcggngggaacg

SEQ ID NO: 437933 - DNA, 568 bp, Homo sapiens
  misc_feature: GZ8MTXP01CEI4H.21.23.C01.1.454.CMB.2.raw
  modified_base (350)..(350): a, c, t, g, unknown or other
  modified_base (432)..(432): a, c, t, g, unknown or other
  modified_base (497)..(497): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaaggtgtccagtgtgaggtgcagctggtggagtccggggaggcttagttcagccgtgggggtccctgagactctcctgtgcagcctctggattcaccttcagtagctactggatgcactgggtccgcaagctccgaggggagggctggtgtgggtctcacgttataagtagtgatgggatacgcanaagctacggcggactccggtagaaacgggcccgattccaactatctaccagacgacaacgaccaaagaaacacgctagtacnctagacaaagtcggaaacaggttcaggaagagccgaggaacacgggtctggtgtattaactgttnacgaaacggccccaagaacgttggaacctaacgccaagtcggacgttcgtaacggggaacgaaaaccgggg

SEQ ID NO: 437934 - DNA, 609 bp, Homo sapiens
  misc_feature: GZ8MTXP01DJSZO.21.23.C01.1.454.CMB.2.raw
  modified_base (246)..(246): a, c, t, g, unknown or other
  modified_base (260)..(260): a, c, t, g, unknown or other
  modified_base (270)..(270): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttcgtgtaggctatttaaagtgtcagtgtgaggtgcagctggtggagtccgggggaggcttagttcagccgtgggggtcctgagactctctgtgcagcctntaggattcaccttnagtagctagnggatgctacgtcgggccacaagcgtacggaggggagggtcgtgggtggtggtctacgtaacgtttaataagtaggtagtaggtgggaagtacgacaacgagacgtacggaccggtactccggaggaacgggacctataccacataccacaagaacaacaacgaacgaaacgaacacgactacgtactactagaacgaaagtaacgaacgtagtacgtagagacgacgacggaacgacgtacgtagtagtagtaacgtgttacgacgaaccgaaccgaacgaacgacgttaacgtaacgacgtaacgtacggtacggttacggtaacgggaacggaacgg

SEQ ID NO: 437935 - DNA, 546 bp, Homo sapiens
  misc_feature: GZ8MTXP01CX7V9.21.23.C01.1.454.CMB.2.raw
  modified_base (275)..(275): a, c, t, g, unknown or other
  modified_base (393)..(393): a, c, t, g, unknown or other
  modified_base (441)..(441): a, c, t, g, unknown or other
  modified_base (446)..(446): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcaccttcagtagctacnggatgcactgggtccgccaaagctccgaggggaaggggctgggtgtgggtctcgacgttataatagtgatggggagtagcacaagctacgcggactccgtgaaagggccgatcaccanctccagacgacaacgccaaagaacacgctgatctgacaaatggaaacngttcngagagccgaggacacggtctgtgtattaacgtgttgcaaaggccccaagaaccgttgggaactaacgccaagtcgggacgttcgtgggggcaaaacgggg

SEQ ID NO: 437936 - DNA, 512 bp, Homo sapiens
  misc_feature: GZ8MTXP01B74HJ.21.23.C01.1.454.CMB.2.raw
  modified_base (285)..(285): a, c, t, g, unknown or other
  modified_base (370)..(370): a, c, t, g, unknown or other
  modified_base (385)..(385): a, c, t, g, unknown or other
  modified_base (387)..(387): a, c, t, g, unknown or other
  modified_base (390)..(390): a, c, t, g, unknown or other
  modified_base (404)..(404): a, c, t, g, unknown or other
  modified_base (406)..(406): a, c, t, g, unknown or other
  modified_base (424)..(424): a, c, t, g, unknown or other
  modified_base (432)..(432): a, c, t, g, unknown or other
  modified_base (440)..(440): a, c, t, g, unknown or other
  modified_base (444)..(444): a, c, t, g, unknown or other
  modified_base (448)..(448): a, c, t, g, unknown or other
  modified_base (453)..(453): a, c, t, g, unknown or other
  modified_base (477)..(477): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtgctatttaaaggtgtcagtgtgaggtgcagctggtggaggtccgggggaggcttagttcagccgtgggggtcctgagactctcctgtgcagcctctggattcacttcagtagctactggatgcacgtgggtccncaagctaccgaggggagggctgggtgtgggtctacgacgttaattaataggtgagtggggagtacgcacagctacggcgactcgngaacgggcatcacancncanagacacgcaagacncntgatctgacaaatgaacngtcagagncgagtacncgtntgtntatgngcgacgacgaccagacgttcgacncgcaagtcgggacgttcggtaacgggaacgaacgg

SEQ ID NO: 437937 - DNA, 579 bp, Homo sapiens
  misc_feature: GZ8MTXP01C2EZT.21.23.C01.1.454.CMB.2.raw
  modified_base (275)..(275): a, c, t, g, unknown or other
  modified_base (454)..(454): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggaggcttagttcagccgtgggggtccctgagactctcctgtgcagcctctggattcaccttcagtagctacnggatgcacgtgggtccgccaagcctccgaggggaaggggcgtgggtgtgggtctcgacgttataagtagtgagtgggagtacgcacagctacgcggactccggtaggaacgggccgtattcgaccactctaccagacgacaacgaccaaagaacacgctgtatctgacaaatggaaacnggtacaggagacgccgaggaccacggtctagtgttattaacgtggttagacgaaacggaccccaagaaacgttgggaaacctcgacctaagtcgggacgttcggtaagggggaacgaaaacgggg

SEQ ID NO: 437938 - DNA, 587 bp, Homo sapiens
  misc_feature: GZ8MTXP01DU7DD.21.23.C01.1.454.CMB.2.raw
  modified_base (282)..(282): a, c, t, g, unknown or other
  modified_base (300)..(300): a, c, t, g, unknown or other
  modified_base (431)..(431): a, c, t, g, unknown or other
  modified_base (501)..(501): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttattttaaaaggtgtccagtgtgaggtgcagctgggtgggaggtccgggggaggcttagttcagccgtgggggtccctgagactctcctgtgcagcctctggacttcaccttcagtagctacnggatgcacgtcgggtccnccaagctccgaggggagggctgggtgtggtctcgacgttaattaatagtgagtgggagtacgcagaagctacggacggactccggagaacgggcctataccgacatccacagacacaacgacaaagaaccncgctagtatctagaacaaatgaaactgtccagaacgacgccgaacggtacacggtctaggtgtaattcgngacgaccgaaaccggaccgaagttaaccgttacggaacctaacgacgtaagtcgggacggttcgggtaacggggaacgaaaccggg

SEQ ID NO: 437939 - DNA, 651 bp, Homo sapiens
  misc_feature: GZ8MTXP01CNH45.21.23.C01.1.454.CMB.2.raw
  modified_base (280)..(280): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctcctgtgcagcctctggacttccaccttcagtagctacnggatgcacgtcgggtccgaccaagcctccggaggggaaggggctgggtggtgggtctctacgttaattaagtagtgagtgggagtacgcacgagctacggacggtactcggtaggaacgggccgtattcgacctatcctaccgaagaacgaaccaacgaccaaagaaccacgtctagtaactctagactaaagtcggaaactagttcaggaacgacggccggtaaggaaccgcgggtctaggttagttaacttaacgtggttacggaaccgttaaccgggaaccccgtaaggttaaccgttcgggaaacccttccggaccctaaggttcgggaccggttacgggtaacgggggaaaccgaaaacccggggg

SEQ ID NO: 437940 - DNA, 527 bp, Homo sapiens
  misc_feature: GZ8MTXP01CH1MV.21.23.C01.1.454.CMB.2.raw
  modified_base (289)..(289): a, c, t, g, unknown or other
  modified_base (381)..(381): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaaggtgtccagtgtgaggtgcagctggtggagtccggggaggcttagttcagcctgggggtccctgagactctcctgtgcagcctctggattcaccttcagtagctactggatgcactgggtccnccaagctccgaggggaagggctgggtgtgggtctcacgtataatagtgatgggatacgcacaagctacgcgactcgtagaagggccatcacntctccagagacaacgccaaagaacacgctgtatctagacaaatggaacaagtctagagagccgaggaccaggctgtgtataactgttgcaacggccccagaacgttggaaactcgccaagtcggacgttgtcggggcgaaacgggg

SEQ ID NO: 437941 - DNA, 558 bp, Homo sapiens
  misc_feature: GZ8MTXP01BA3WB.21.23.C01.1.454.CMB.2.raw
  modified_base (242)..(242): a, c, t, g, unknown or other
  modified_base (263)..(263): a, c, t, g, unknown or other
  modified_base (279)..(279): a, c, t, g, unknown or other
  modified_base (325)..(325): a, c, t, g, unknown or other
  modified_base (420)..(420): a, c, t, g, unknown or other
  modified_base (448)..(448): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtagctatttaaagtgtcagtgtgaggtgcagctggtggagtccggggagcttagtcagccgtgggggtcctgagactctcctgtgcagcctntggattcacttcagtagctangatgcacgtgggtccncaagctccgaggggacgggctgggtgtggtctcgacgttattaagngtgagtggggagtacgacacaagccgtacgacgggtacctccggtaggaacgggcctattccaccatcaccagacacgaacgacctaaagaaccncatgtaactcagacaatagggaacagtntagagacgacgaggacgacggtcgtgtgtgttaactgttcgacgacgacccgaacgaacgttacgacgaacgaccgaagtcggacggttacgtcgggaacggaaaccggg

SEQ ID NO: 437942 - DNA, 546 bp, Homo sapiens
  misc_feature: GZ8MTXP01CMFY2.21.23.C01.1.454.CMB.2.raw
  modified_base (277)..(277): a, c, t, g, unknown or other
  modified_base (294)..(294): a, c, t, g, unknown or other
  modified_base (360)..(360): a, c, t, g, unknown or other
  modified_base (394)..(394): a, c, t, g, unknown or other
  modified_base (399)..(399): a, c, t, g, unknown or other
  modified_base (460)..(460): a, c, t, g, unknown or other
  modified_base (474)..(474): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctacnggatgcacgtgggtccnccaagctccgaggggagggctggtgtgggtctcgacgttaattaagtagtgagtgggagtacgcanagctacgcgactccgtgaacgggccatcacatcncaganacaacgccaaagaacacgctagatctagacaaatggaacagtcagagagccgagacacggntgtcgtattaacgngttcgacaaacgggccccaaggaacttggaaacctcgcaagtcgggacgttcgtaagggggaacaaaacggg

SEQ ID NO: 437943 - DNA, 662 bp, Homo sapiens
  misc_feature: GZ8MTXP01C7IME.21.23.C01.1.454.CMB.2.raw
  modified_base (289)..(289): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttattttaaaaggtgtccagtgtgaggtgcagctgggtggaggtccggggggaggtcttagttcaggccgtggggggtccctgagactctcctgtgcacgtcctctggtacttccaccttcagtagctacnggatgcacgtcgggtccgccaagcgtaccgagggggaacggggcgtgggtggtgggtctacgtacgttaataagtaggtgagtgggagtacgcaacgagcgtacggacggactccggaggaacggggcctatccacactccaccgaagacgaacaaacgaccaaagaacacgtctagatcagaacaaagtggaaactggtacaggaacgacgaccggaaggaaccgacggtcttaggttagttaacgtttaacgtggttacggaaccgaaaccgggaccccgaaggttaaacccgttcgggaaaaccttccgggacccgtaaggttccggggaccggttacggggtaacgggggaaccgtaaaaacccggggg

SEQ ID NO: 437944 - DNA, 689 bp, Homo sapiens
  misc_feature: GZ8MTXP01EZTVY.21.23.C01.1.454.CMB.2.raw
  modified_base (391)..(391): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgttgctatttaaaggtgtcagtgtgaggtgcagcgtggtggaggtccgggggagtcttagttcaggccgtgggggtcctagtgacgtctctcgtgcacgcgtctgtacgttactaccttacctagtaggtactactaggtagtcgtcgacctcgggtccggcccgaacgacgtccgacggggaaggggcggtggtggtggtcgtctacgtaagtttaagtagtagagtaggacgtagacganaacgtacgaccgtaacggacgtccgtacggaacgggaccggtactacgtaccacttacgtacccaaggaagaaaccccggaaaccaaacccggaagtttaaaaaccgcccggtttactacgttaacacgtaacgaaagaaacgtaaacggtaacgtaacgtacgtacggacggaacggaccggaacggacggacggtacgtacgttagttagttaacgtacgttacgtacgaccgaccgaacgaacgttacgacgtaacgacgaacgacggtacggttacggtaacggaacggaacgg

SEQ ID NO: 437945 - DNA, 614 bp, Homo sapiens
  misc_feature: GZ8MTXP01CKDVP.21.23.C01.1.454.CMB.2.raw
  modified_base (278)..(278): a, c, t, g, unknown or other
  modified_base (447)..(447): a, c, t, g, unknown or other
  modified_base (459)..(459): a, c, t, g, unknown or other
  modified_base (532)..(532): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagcgtggtggaggtccgggggaggcttagttcagcgtggggggtcctgagactctcctgtgcagcctctggacttcaccttcagtagctacnggatgcacgtgggtccgccaagcctaccgaggggaagggctgggtgtgggtctcagtaattaagtagtgagtggagtacgcagaagctacggacggactccggtagaaggggaccgtactcgaacctatccaccgaaggacaaccaaacggacccaaaaggtaaacccncgtcttagtacncgtaagaactaaagtacggaaacgagtacagggaacgacgaccggaggaccgcggtcttagtagttaattcgngaccggacgaaaccggacccaagttaaccgttcgaaacctcgcgtaaggacgggacggttacggtaagggaaccgtaaacgg

SEQ ID NO: 437946 - DNA, 728 bp, Homo sapiens
  misc_feature: GZ8MTXP01BYVMS.21.23.C01.1.454.CMB.2.raw
  modified_base (243)..(243): a, c, t, g, unknown or other
  modified_base (275)..(275): a, c, t, g, unknown or other
  modified_base (509)..(509): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttcgtgtagctattaaagtgtcagtgtgagtgcagctggtggaggtccggggagtcgttagttcgagccggtgggggtccctgagtactctctgtgcncgtctgtgtacttcacgttcgagtcgactagngagtcgacgtacgtcggaccgacgacgtccgacggaggggacggtgtggtcggtacgtactacgtaagttagtagtaggtagtaggtacggtaagtaccgacgaacgtacgtcgtacggtaaccgtaccggtcggtaagggtaaccgggtaccctactaccgactacgtacgaacgaagtaacgaacccgaacgaacgttaaacggtaacgtcgttactacgtaactacgtaanaacgtaaacgtaacggtaacgtacgtacgtacggtaacggtaaccggaccggaacggtaacggtacggtacgttacggttacgttaacgttaacgttacggttacggtaaccggaacccggtaaacccggtaacgttaacgttaaccggttaaccgtaaccggtaccggtaacggtacgggtaccgggttacgggtaacgggttaaccgggtaaccggg

SEQ ID NO: 437947 - DNA, 599 bp, Homo sapiens
  misc_feature: GZ8MTXP01APO1K.21.23.C01.1.454.CMB.2.raw
  modified_base (296)..(296): a, c, t, g, unknown or other
  modified_base (399)..(399): a, c, t, g, unknown or other
  modified_base (499)..(499): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagctgggtggaggtccgggggaggcttagttcaggccgtggggggtccctgagactctcctgtgcagcctctggattcaccttcagtagctactggatgcacgtgggtccnccaagcctcgaggggacgggctgggtgtgggtctcgatgttattaatgtgagtgggatagcagagctaacgcggctccggtaggacgggccattcactatccncagacgacaacgacaaagtaaccacgctagtactcgtagaacaaaggttacgaaacgtagtaccgaggacggacggacccggtaagggaccgaccgggtntaggtagttaacttacgttggacgacgaaaccgggccccaaggaacttacgggaacctccggaaccaggtacgggaccgttcgggaacggggaaacccgg

SEQ ID NO: 437948 - DNA, 647 bp, Homo sapiens
  misc_feature: GZ8MTXP01D853G.21.23.C01.1.454.CMB.2.raw
  modified_base (467)..(467): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgctattttaaaaggtgtccagtgtgaggtgcagctggtgggaggtccggggggaggtcttagttcagccgtggggggtccctgagactctcctgtgcagcctctggtacttcaccttcagtagctacgtggatgccacgtcgggtccgccaacgctaccggaagggggaggggtcgtgggtggtgggtctacgacgtttaattaagtaggttgagtggggagtacgcaacaagctaccggacggtactccggtaggaacgggcccgtattccaacctatcctaccaagacgaacaaccgaccaaagaaccncgatgtatcgtagaacaaaagtcggaaactggtactcggaaagccgcggaagacgcggtcttggtagttattaacgtgttacggaccgttaaacggacccctaagggaaacccgttgggaaacccgtccgaccgtaaggtcggggaccgttacgggtaacggggaacgaaaacccggggg

SEQ ID NO: 437949 - DNA, 532 bp, Homo sapiens
  misc_feature: GZ8MTXP01C12CO.21.23.C01.1.454.CMB.2.raw
  modified_base (276)..(276): a, c, t, g, unknown or other
  modified_base (292)..(292): a, c, t, g, unknown or other
  modified_base (324)..(324): a, c, t, g, unknown or other
  modified_base (382)..(383): a, c, t, g, unknown or other
  modified_base (385)..(385): a, c, t, g, unknown or other
  modified_base (387)..(387): a, c, t, g, unknown or other
  modified_base (389)..(389): a, c, t, g, unknown or other
  modified_base (398)..(398): a, c, t, g, unknown or other
  modified_base (400)..(400): a, c, t, g, unknown or other
  modified_base (402)..(407): a, c, t, g, unknown or other
  modified_base (409)..(409): a, c, t, g, unknown or other
  modified_base (412)..(412): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
  modified_base (443)..(443): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctacnggatgcactgggtccnccaaagccacgaggggaggctggtggtggtcncagttaataatagtgagtgggagtacgcaacagcacgcgactcgagagggacatcacnncnananacacacaananannnnnnanaanaganananagagagcgacgacgacgtgtgtntataatgttgacgaaccgacccgaacgaacgacgaaacgaaccgaccgaacgtacggtacggttacggtaacggggaacgggaaacggg

SEQ ID NO: 437950 - DNA, 562 bp, Homo sapiens
  misc_feature: GZ8MTXP01EXT1W.21.23.C01.1.454.CMB.2.raw
  modified_base (279)..(279): a, c, t, g, unknown or other
  modified_base (298)..(298): a, c, t, g, unknown or other
  modified_base (372)..(372): a, c, t, g, unknown or other
  modified_base (389)..(389): a, c, t, g, unknown or other
  modified_base (437)..(437): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggtcttagttcagccgtggggggtccctgagactctcctgtgcagcctctggattcaccttcagtagctacnggatgcacgtcgggtcccnccaagccgtccgaagggggacggggtctgggtggtgggtctacacggttattaagtagtgagtgggatacgcanagctacgacggactcgngaagggccattcacatcacagacacaacgccaaagaacacgctagtanctagactaaatcgggaactagtcagagacgcgaggacaggtctgtagtataactgttcgaccgaacgccccaagacgttggaacctaacggccaagtggaccgttggcggggaacgaaaccgggg

SEQ ID NO: 437951 - DNA, 702 bp, Homo sapiens
  misc_feature: GZ8MTXP01B7RZV.21.23.C01.1.454.CMB.2.raw
  modified_base (283)..(283): a, c, t, g, unknown or other
  modified_base (499)..(499): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagcgtggtggaggtccgggggaggtcttagttcaggccgtgggggtccctgagactctcctgtgcagcctctggtacttccacttcagtacgctacgnggatcgctacgtcgggtcccgaccaacgccgtaccggagggggagggcgtgggtggtcgggtctacgacgtttaattaagtagtgtagtggggagtacgacacgagccgtacggacggactccggtagggaacgggcccgtacttccgaaccgtacttacccaccgaaggaacgaacccaaaccggaacctaaaggaaacctacggtctaggtacnccgtagaacctaaaagtcggaaacgtacggttaccaggaacggacggccccggaaaggacccgtaacgggtcttaaggttacgtttaacgttaaccgtgggttaccgaccgaaaccggaccccgttaaagaaccggttcggaaaccgttaaccggccgtaagtacggggccgttacgggtaacggggaacccgtaaaacgggg

SEQ ID NO: 437952 - DNA, 552 bp, Homo sapiens
  misc_feature: GZ8MTXP01CZGQG.21.23.C01.1.454.CMB.2.raw
  modified_base (280)..(280): a, c, t, g, unknown or other
  modified_base (297)..(297): a, c, t, g, unknown or other
  modified_base (386)..(386): a, c, t, g, unknown or other
  modified_base (389)..(389): a, c, t, g, unknown or other
  modified_base (394)..(394): a, c, t, g, unknown or other
  modified_base (406)..(406): a, c, t, g, unknown or other
  modified_base (409)..(409): a, c, t, g, unknown or other
  modified_base (430)..(430): a, c, t, g, unknown or other
  modified_base (466)..(466): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggagcttagttcagccgtgggggtccctgagactctcctgtgcagtcctctggtacttccaccttcagtagctacgnggatgcacgtgggtccncaagctcgaggggagggctgggtgtgggtctcgacgttataatagtgagtgggatacgcagagcacgcgactcggagaagggcatcacntcncaganacacgcaagacncgntagatcagacaaatggaaacngtcagagcgcgaggacacgggtctgtgtattaacgnggttacaccgaacggacccctaaggaaaccgttcgggaaacctcggacctaaggtcgggacgttcggcgggggaacgaaaccgggg

SEQ ID NO: 437953 - DNA, 546 bp, Homo sapiens
  misc_feature: GZ8MTXP01EA0EN.21.23.C01.1.454.CMB.2.raw
  modified_base (278)..(278): a, c, t, g, unknown or other
  modified_base (294)..(294): a, c, t, g, unknown or other
  modified_base (375)..(375): a, c, t, g, unknown or other
  modified_base (392)..(392): a, c, t, g, unknown or other
  modified_base (411)..(411): a, c, t, g, unknown or other
  modified_base (422)..(422): a, c, t, g, unknown or other
  modified_base (459)..(459): a, c, t, g, unknown or other
  modified_base (477)..(477): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtgggagtccgggggaggcttagttcaggccgtgggggtccctgagactctcctgtgcagcctctggattcaccttcagtagctacnggatgcactgggtccncaagctccgaggggagggctggtgtggtctcgacgtattaatagtgagtgggagtagcacgaagctacggcggactccggngaagggccatcacatcncagagacacgccaagaacncgctgatctanacgaaatggaaactagtctagagacggccgagggacncggcttggtgtattaacnggttcacgaacgcccaaggaacttcgggaaacctcgcaagtcggacgttcgtcggggaacaaaacgggg

SEQ ID NO: 437954 - DNA, 739 bp, Homo sapiens
  misc_feature: GZ8MTXP01EOII3.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttaattttaaaaggtgtccagtgtgaggtgcagcgtggtggaggtccggggagtcttagttcagccgtgggggtccctgagtactctccgtgtgcagcctcgtggacttcacttcagtagctacgtgatgcacgtcgggtcccaccgaagcctaccggaagggggtaacggggtcgtgggttggtcggggttctacgtaacgtttaattaaagtgtagagtgggatacgcaagaagcctacggacggtacctccggtagggaaacgggtccgtaacttaccgaaccacgttacccacccgaaggaaaccgaacccgaaaccgaaccccgtaaaaggaaacccgaccgtacgttaggtaaacttaccctaaggaacctaaaagttacggggaaaccgttagttaccgtaggaacgaccggaacccgggtacgaaacgtcgggtaccttagggttagttactttaaaccgtgggttaagaccccggaaacggcccccttaaaggaaaccgttacgggaaaccttaacccggacctaaggtccggggtacgttacccgggttaaggggaaaccgtaaaccgggg

SEQ ID NO: 437955 - DNA, 577 bp, Homo sapiens
  misc_feature: GZ8MTXP01BMY0I.21.23.C01.1.454.CMB.2.raw
  modified_base (293)..(293): a, c, t, g, unknown or other
  modified_base (390)..(390): a, c, t, g, unknown or other
  modified_base (417)..(417): a, c, t, g, unknown or other
  modified_base (462)..(462): a, c, t, g, unknown or other
  modified_base (475)..(475): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggaggcttagttcagccgtggggggtccctgagactctcctgtgcagcctctggattcaccttcagtagctactggatgcacgtgggtccnccaagctccgaggggagggctgggtgtgggtctgacgttattaagtgtgagtggggatacgcagaagctacgcggactcgtgagggccatcacatcncagacacaacgcaagacagtctagtanctagactaaatggaaactgtacctagaacgcggaccgaggaaccncggtcttaggttntaattaacgtggttacgaccgaaacgggccccaagttaaccgttgggaaacccttcggccctaagtcgggaccgttcggtaacgggggaacaaaaccggggg

SEQ ID NO: 437956 - DNA, 667 bp, Homo sapiens
  misc_feature: GZ8MTXP01BDS56.21.23.C01.1.454.CMB.2.raw
  modified_base (263)..(263): a, c, t, g, unknown or other
  modified_base (506)..(506): a, c, t, g, unknown or other
  modified_base (558)..(558): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgttgctatttaaagtgtcagtgtgagtgcagctggtggaggtccggggagtcttagtcagcgtggggtcctgagctctctgtgcagtcctgtgacttcaccttcagtagctacnggatgactacgtcgggtacccacgaacgccgtaccggaagggggaacggggtcgttggggtcggttcggggtacttacgtaacgtttaatttaaagtaggttaggaggttacggggaagttaacggacaaacgaacgccgttaacggacccggtaccgtcccggtaggaaacggggtcctacttaccaaccacttacccaccgagaacaacgaaccgactaaagacacgtactagtactacgngaaactaaatcgggaaactagtacaggaacgacgaccggtagaaccgcggtnttagtacgttaagtcgttaggccgtaacgaaccggtaccccgaagttaacgacggaaccgtaaccgcgtaagtccgggacgttacgggtcggggaacgtaaacccgggg

SEQ ID NO: 437957 - DNA, 708 bp, Homo sapiens
  misc_feature: GZ8MTXP01B7V9Q.21.23.C01.1.454.CMB.2.raw
  modified_base (252)..(252): a, c, t, g, unknown or other
  modified_base (278)..(278): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccggggagcttagttcagccgtgggggtccctgagactctcctgtgcagcctntggtacttcaccttcagtagctacgnggatgcacgtcgggtccgccaagcctccgaggggaggggctggggtgtgggtctcgtaacgttattaagtaggtgagtggggatacgacaacgagctaccggcgggactccggtaggaacgggccctacttccaccatcctaccgaagacgaaccaaccgaccaaagaaaccacggtcttaggtataccgtaggaactaaaacttggggaaaacgtaggttaccgtaagggaacggaaccgggaccccggggaaaggtaacccggaaccgggtcgtttagggttacgtttaacgtttaacgtgggttaccggacccgaaaccggggtacccccctaaagggaaaccgttccgggaaaacccttaaccgggacccgtaagggttaccgggaccgggtttaccggtaacggggggaaccgtaaaaccggggg

SEQ ID NO: 437958 - DNA, 783 bp, Homo sapiens
  misc_feature: GZ8MTXP01D5PUH.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgctattttaaaaggtgtcagtgtgaggtgcagctggtgggaggtccgggggaggcttagttcagccgtgggggtccctgagactctcctgtgcagcctctggacttcaccttcagtagctactggatgcacgtcgggtcccgaccaagccgtaccggagggggaacggggtcgttggggtggtcgggggttcctacgtaacgtttaatttaaagtaggttaggaagtgggggaagtaacgacaaacgaagtccgtaacggaccgggaaccttccgggtaggaaacggggtccctaattacccaaccgtattcctaccgaaaggaacgaaacccaaaccggaccctaaaagaaccgacggtaccttaggtaactccgtagaaacctaaaagttacgggaaaacctggtttaccgaagggaaacggaaccggggacccggaaggggaaacccgtaacggggtctttaggggttaactttaaacgtttaaccgtgggttaccgaacccgaaaccggggtaccccccaaagggttaaacccgttcgggaaaacccttaacccgggaccgttaagggtcggggtaacccgggttacgggtaaccggggggaaaaccgtaaaaccccgggggg

SEQ ID NO: 437959 - DNA, 564 bp, Homo sapiens
  misc_feature: GZ8MTXP01ATXYS.21.23.C01.1.454.CMB.2.raw
  modified_base (274)..(274): a, c, t, g, unknown or other
  modified_base (292)..(292): a, c, t, g, unknown or other
  modified_base (359)..(359): a, c, t, g, unknown or other
  modified_base (401)..(401): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagccgtgggggtccctgagactctcctgtgcagcctctggattcaccttcagtagctacnggatgcacgtgggtcccnccaagctccgaggggaagggctgggtgtgggtctcgacgtattaagtagtgagtggggagtacgcanaagctacggcggactcccggtagaaacggggcattcacatcncagacacaacgacaaagacacgctgtatctagacaaatcggaacagtcaggagcgccgaggacacggtctggtatattaactgttcgacaacgggccccaagacgttcgggaacctaacggccaagttcgggaacgttcgggaaggggaaccgaaaaccgggg

SEQ ID NO: 437960 - DNA, 564 bp, Homo sapiens
  misc_feature: GZ8MTXP01BXVG2.21.23.C01.1.454.CMB.2.raw
  modified_base (277)..(277): a, c, t, g, unknown or other
  modified_base (294)..(294): a, c, t, g, unknown or other
  modified_base (440)..(440): a, c, t, g, unknown or other
  modified_base (465)..(465): a, c, t, g, unknown or other
  modified_base (475)..(475): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggaggtccgggggaggcttagttcagccgtgggggtccctgagactctcctgtgcagcctctggattcacttcagtagctacnggatgcacgtgggtccnccaagctccgaggggagggctgggtgtgggtctcgacgtattaagtagtgagtggggagtacgcagaagctacggacggactaacggtggaacgggccgattcgaccatctccagaacgacaacgaccaaagaaccacgctagtanctagacaaatggaactagtcagagngccgagaccncggtctgtgtataacgtgttcgacgaacgccccaagaaccgttggaaacctcgcctaagtgggaccttcggtggggaaccgaaacgggg

SEQ ID NO: 437961 - DNA, 582 bp, Homo sapiens
  misc_feature: GZ8MTXP01AOO0A.21.23.C01.1.454.CMB.2.raw
  modified_base (255)..(255): a, c, t, g, unknown or other
  modified_base (279)..(279): a, c, t, g, unknown or other
  modified_base (297)..(297): a, c, t, g, unknown or other
  modified_base (441)..(441): a, c, t, g, unknown or other
  modified_base (467)..(467): a, c, t, g, unknown or other
  modified_base (486)..(486): a, c, t, g, unknown or other
  modified_base (492)..(492): a, c, t, g, unknown or other
  modified_base (506)..(506): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgctattttaaaaggtgtccagtgtgaggtgcagctggtggaggtccgggggaggcttagttcagccgtgggggtccctgagactctcctgtgcagcctntggattcaccttcagtagctacgnggatgcacgtcgggtccnccaagctccgaggggagggctgggtgtgggtctcgacgttattaagtaggtgagtggggagtacgcacgaagctacggacggacgtccggtggaaacgggcctatccacactcctaccaagacgaaccaacgaccaaagaaccncgtctgtaactcagacaaagtgaacngtcagagacgccgaggacncgggtntagtgtattaacgngttacgacgaacgggccccaaggaaccgttggaaacctcgctaagtcgggacgttcgtaaggggaaccaaacgggg

SEQ ID NO: 437962 - DNA, 707 bp, Homo sapiens
  misc_feature: GZ8MTXP01ACY15.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggtttttccttgttgcttaattttaaaaggtgtccagtgtgaggtgcagcgtggtggaggtccgggggaggcttagttcaggccgtgggggtccctgagactctcctgtgcagcctctggattccaccttcagtacgctacgtggatgcacgtcgggtcccgaccaagccgtaccgagggggaacgggcgtgggtgtgggtctacgtacgttaatttaagtagtgagtggggagtacgacacgaaagcctacggccggacgtcccgggtaggaaacggggtccgtactttaccgaccctacttcccacccgaagaaccgaaccaaacccggacccaaaagtaaccgaccgtacctagttaactccgtaacgaacctaaaagtacggggaaactaggttaccagggaacgacgggaccgtaagggaaccgtacgggtctaggttcgttaaattaacgtgttacggaaccgaaaccggaccccgtaaaggaaccgttacgggaaaccctcggacccgtaaggttccggggacgttcgggtaacgggggaaacccgaaaaccggggg

SEQ ID NO: 437963 - DNA, 686 bp, Homo sapiens
  misc_feature: GZ8MTXP01DB90V.21.23.C01.1.454.CMB.2.raw
  modified_base (294)..(294): a, c, t, g, unknown or other
  modified_base (490)..(490): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttattttaaaaggtgtccagtgtgaggtgcagcgtggtggaggtccggggggagtcttagttcaggccggtcgggggtccctgagtactcctccgtgtgcacgtcctcgtggtacttccaccttcagtagctacgnggatcgcacgtcgggtcccaccgaacgccgtaccggagggggacgggtcgtgggtggtcggtctacgtacgttaattaagtaggtagagtgggagtacgcaacgagccgtacggaccggacgtccggagggaaccgggccgtacttaccacacttaccgaccgaagaaccgaacaaccgaccgaaagaacctcgtntacgtatcgtaagaactaaagtcgggaaactcgttaccgaggaacgacggaccgaaggaaccacggtcttaggtacgtttaattcggtaggttaccgaacccgaaaccgggtaccccaagttaacccgttcggaaaccctaaccggacgtaagggtacgggacgttacggggtaacggggaaccctaaaccggggg

SEQ ID NO: 437964 - DNA, 569 bp, Homo sapiens
  misc_feature: GZ8MTXP01APZ26.21.23.C01.1.454.CMB.2.raw
  modified_base (258)..(258): a, c, t, g, unknown or other
  modified_base (279)..(279): a, c, t, g, unknown or other
  modified_base (298)..(298): a, c, t, g, unknown or other
  modified_base (375)..(375): a, c, t, g, unknown or other
  modified_base (408)..(408): a, c, t, g, unknown or other
  modified_base (430)..(430): a, c, t, g, unknown or other
  modified_base (433)..(433): a, c, t, g, unknown or other
  modified_base (443)..(443): a, c, t, g, unknown or other
  modified_base (449)..(449): a, c, t, g, unknown or other
  modified_base (479)..(479): a, c, t, g, unknown or other
  modified_base (484)..(484): a, c, t, g, unknown or other
  modified_base (491)..(491): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggtttttccttgttgcttattttaaaaaggtgtccagtgtgaggtgcagcgtggtggaggtccgggggaggcttagttcagccgtgggggtccctgagactctctgtgcagcctntgattcacttcagtagctacnggatgcacgtgggtacccnccaaagcctaccgaagggggaagggctgggtagtgggtctctaacgttaattaagtagtagagtgggagtacacaanaagctacgacgactcgagacgggcatcacatcncagacgacaacgacaaagaacncgntgtatcgaanacaaanggaaacagtcagagacgacgagacgacgtntagtntaattgngttacacgaaaccgacccgaagaacgttcgaactaacgacaacggtcggaccggttacgggaacgggaacgaaacggg

SEQ ID NO: 437965 - DNA, 625 bp, Homo sapiens
  misc_feature: GZ8MTXP02JOQ3Y.21.23.C01.1.454.CMB.2.raw
  modified_base (246)..(246): a, c, t, g, unknown or other
  modified_base (265)..(265): a, c, t, g, unknown or other
tcagtcgtcgctcgcacgaccggtgctcgatttagtacacgtgattagggattggggcccagccctgggattcccagctgtttctgcttgctgatcaggactgcacacagagaactcaccatggagtttgggctgagcgtggtttcgtgtagctatttaaagtgtcagtgtgagtgcagctggtggagtccggggaggcttagttcagcctgggggtccctgagactctcctgtgcagctctggtntctactcagtagctactgntgcacgtcggtccgcgacgcgcgagggagggcgtggtggtggtcgtcgtacgttaagttaagttagtagtagtagggtaggtacgacgacgaacgacgtacggaccggtacgtccggtacgggaacgggtaccggtacgttaccgtacctactacctaccgaacgaacgaaccgaaaccgaacccgaaacgaaacgaaccgacgtacgtacgtacgtacgaacgtaaacgtaacgtaacgtagtacgtaggagacgacggacggacgacggacgtagtagtagttacgtagtacgacgacgaccgacgaacgtacgaacgtaacgacgacgtacggacggtacggtacgggacggaacgg

SEQ ID NO: 437966 - DNA, 719 bp, Homo sapiens
  misc_feature: GZ8MTXP02JKWJ7.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtagctatttaaaaggtgtcagtgtgaggtgcagctggtggagtccgggggagcttagtcagcctgggggtccctgagactctcctgtgcagcctctggatcaccttcagtagctactggatgcactggtcgccaagctccagggaaggggcgtggtgtgggtcgtcacgtattaatagtgagtgggagtaggacacaagacgtacgaccggtaaccgtccggttacgggaaaacggggccggggtaaacgtttccgtaacccgaaacgtccgttaccccaagaacggaaaccaaaaccgggaccccgaaaaacgaaaccgaccgacgtacgtacgtacgtacgtaaacgtaaacgtaaacgtaacgtaacgtacgtacggaacggaacggaaccggaacgggaacggaacggtacggttacggttagttaacgtttaacggttacggtacggtaaccggaaacccggaaccccggtaaaccggtaaaccggtaaccggtaaaccgtaaccggtaccgtaacggtacgggtaccgggtaccgggtaaccggggtaaccgggaaaccgggg

SEQ ID NO: 437967 - DNA, 707 bp, Homo sapiens
  misc_feature: GZ8MTXP02II0XK.21.23.C01.1.454.CMB.2.raw
  modified_base (309)..(309): a, c, t, g, unknown or other
tcagtcgtcgctcgcacgaccggtgctcgatttagtacacgtgattagggattggggccccagccctgggattcccagctgtttctgcttgctgatcaggactgcacacagagaactcaccatggagtttgggctgagcgtggtttcgtgttagcgtatttaaaaggtgtcagtgtgaggtgcagctggtggagtccggggaggcttagttcagcctgggggtccctgagactctcctgtgcagcctctggattcaccttcagtagctactggatgcacgtggtcccgcaagctccgaggggaaggggngtggtggtggtcgtcgtacgtagttaagtagtagtagtaggtaggtacgacgacgaacgacgtacggacggacgtccggtacggaacgggaccgtacgtacctaccactacctaccacgaacgaaccgaaccgaaccgaaacgaaaccgaaccgtacgtacgtacgtacgtacgtaacgtaaacgtaagtaaacgtaacgtacgtacggaaggaacggaccggaacggaaccggaacggtacgttacggttacgttaacgtttaacgttacggtacggtaaccggaaacccggaacccggtaaccggtaaaccggtaaccggtaaaccgtaacccgtacccgtaacggtaccgggtaaccgggtaccgggtaaccggggtaaaccgggaaaaccgggg

SEQ ID NO: 437968 - DNA, 616 bp, Homo sapiens
  misc_feature: GZ8MTXP02I67IL.21.23.C01.1.454.CMB.2.raw
  modified_base (150)..(150): a, c, t, g, unknown or other
  modified_base (236)..(236): a, c, t, g, unknown or other
  modified_base (244)..(244): a, c, t, g, unknown or other
  modified_base (255)..(255): a, c, t, g, unknown or other
  modified_base (257)..(257): a, c, t, g, unknown or other
  modified_base (260)..(261): a, c, t, g, unknown or other
  modified_base (264)..(264): a, c, t, g, unknown or other
  modified_base (278)..(278): a, c, t, g, unknown or other
  modified_base (287)..(287): a, c, t, g, unknown or other
tcagtcgtcgctcgcacgaccggtgctcgatttagtacacgtgattagggattggggccccagccctgggattcccagctgtttctgcttgctgatcaggactgcacacagagaactcaccatggagtttgtgctgagcgtggtttcgtntaggctattaaagtgtcagtgtgagtgcagctggtggagtccgggggagcttagtcagcgtggggtccgtgagactctcctgtgcngctctgtntctctcagtantntgnngcncgtcggtcgcagcncgaggaggngtggtggtggtcgtcgtacgtattaagtagtagtagtaggtagtagacacgacgacgtacgacggtccgtaccggtacggaacggaccgtacgtacacctactaccgtaccgacgaacgaacgaaccgaaccgaaacgaacgaacgacgtacgtactacgtacgtaacgtaaacgtaacgtaacgtaacgtacgtagacgacggacggaacggacggacggtacgtacgttagttacgttacgttacgtacgtacgaaccggacccgaaccgtaacgtaacgtaaccgtaccgtaccgtacgtacggtacggtacggtacgggtaacgg

SEQ ID NO: 437969 - DNA, 704 bp, Homo sapiens
  misc_feature: GZ8MTXP02IRGAZ.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggaggcttagttcagccgtgggggtcctgagactctcctgtgcagcctctggattcaccttcagtagctactggatgcacgtgggtccgaccaagctaccgaggggagggctgggtgtgggtctcgacgttattaagtagtgagtggggagtacgcaacgaagctacggcggactccggtaggaaacgggccgtattccacacttccacccgaagacgaaaccaaaccggaccaaaacgaaaccaccggacttagtaaactctagaaacctaaaattcgaaaacctagttccaggaacggaacggcccggaaaggggaacccacgggggcctttaggggttacgttaaaactttaccggttggtacggaaccgtaaaaccgggggacccccctaaagggaaaacccgttacgggggaaaaaccccttaaccggacccgtaaacgggttacgggggtaacccgtttaccggggtaacggggggaaacccaaaaacccgggggg

SEQ ID NO: 437970 - DNA, 528 bp, Homo sapiens
  misc_feature: GZ8MTXP02IXK12.21.23.C01.1.454.CMB.2.raw
  modified_base (370)..(370): a, c, t, g, unknown or other
  modified_base (385)..(385): a, c, t, g, unknown or other
  modified_base (431)..(431): a, c, t, g, unknown or other
  modified_base (465)..(465): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcactgggtccgccaagctccgaggggaagggctggtgtgggtctcacgtattaatagtgatgggagtagcacaagctacgcgactcgngaggccatcacatcncagagacaacgccaaagaacacgctgtatctagacaaaatgaaacngtctgagagccgaggacacggctagtgtattacngtgcaaacggccccagaaacctggaaactcgccaagtcggacgtcgagggggacaaaacgggg

SEQ ID NO: 437971 - DNA, 524 bp, Homo sapiens
  misc_feature: GZ8MTXP02H7EF1.21.23.C01.1.454.CMB.2.raw
  modified_base (381)..(381): a, c, t, g, unknown or other
  modified_base (387)..(387): a, c, t, g, unknown or other
  modified_base (430)..(430): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggtttccttgttgctatttaaaaggtgtccagtgtgaggtgcagctggtggagtccgggggaggcttagttcagcctgggggtccctgagactctcctgtgcagcctctggattcaccttcagtagctactggatgcactgggtccgccaagctccgaggggagggctggtgtgggtctcacgtattaatagtgatgggatagcacagctacgcggactcgtgaaggccgatcacatcnccaganacaacgccaaagaacacgctagatctgacaaatgaactagtcngagagccgaggacacggctgtgtattacgtgtacgcaaacggccccaagaactggaacctaacgccaagtcggacgtcgtaggggacaaacggg

SEQ ID NO: 437972 - DNA, 612 bp, Homo sapiens
  misc_feature: GZ8MTXP02HGJJO.21.23.C01.1.454.CMB.2.raw
  modified_base (435)..(435): a, c, t, g, unknown or other
tcagtcgtcgctcgcacgaccggtgctcgatttagtacacgtgattagggattggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcaggccgtgggggtccctgagactctcctgtgcagcctctggattcacttcagtagctactggatgcacgtgggtcccgacaagcgtaccgaggggaagggctgggtggtggtctcacgttattaagtagtgagtgggagtacgacaacgagctacggcggactccggtaggaacggccattcacatccacagacacaacgacaaagacacgctagtancgtagaacaaatcgaaactagtcaggaagacgccgaaggtaccagggtctaggttagtacgtttacgcggtacggaaccgaaaccgggccccaaaggtaaacccgttagggaaaaccctccggacccgtaaagttcggggaccgttaccgggaacgggggaaaccgaaaaccggggg

SEQ ID NO: 437973 - DNA, 551 bp, Homo sapiens
  misc_feature: GZ8MTXP02JYHMW.21.23.C01.1.454.CMB.2.raw
  modified_base (355)..(355): a, c, t, g, unknown or other
  modified_base (425)..(425): a, c, t, g, unknown or other
  modified_base (441)..(441): a, c, t, g, unknown or other
  modified_base (479)..(479): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctactggatgcacgtgggtccgccaagctccgaggggaagggctggtgtgggtctcacgtattaatagtgagtgggatacgcanaagctacgcggactccggtgaacgggccgattccacatcaccagagacaacgccaaagacacgctagtanctagacaaatgaaacngtcaggagagccgaggacacggcttaggtgtattacgngtgacaaacggccccaaggaacctggaaacctcgacctagtcgggaccgtcggtacggggacaaaacggggg

SEQ ID NO: 437974 - DNA, 554 bp, Homo sapiens
  misc_feature: GZ8MTXP02G90RA.21.23.C01.1.454.CMB.2.raw
  modified_base (353)..(353): a, c, t, g, unknown or other
  modified_base (392)..(392): a, c, t, g, unknown or other
  modified_base (397)..(397): a, c, t, g, unknown or other
  modified_base (423)..(423): a, c, t, g, unknown or other
  modified_base (441)..(441): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagcctgggggtccctgagactctcctgtgcagcctctggattcaccttcagtagctactggatgcactgggtccgccaagctccgaggggagggctggtgtgggtctcgacgttattaagtagtgagtgggatagcanaagctacgcggactccggtgaacgggccgattcacatcncaganacaacgccaaagaacacgctagtacnctgacaaatgaacagtcnggagagccgaagggacctacggctggtatattactggtacgacgaaacggccccagaaacgtggaaaacctcggccaaagttcggggaactcgtacgggggacaaaaccgggg

SEQ ID NO: 437975 - DNA, 548 bp, Homo sapiens
  misc_feature: GZ8MTXP02HO5X8.21.23.C01.1.454.CMB.2.raw
  modified_base (397)..(397): a, c, t, g, unknown or other
  modified_base (447)..(447): a, c, t, g, unknown or other
  modified_base (465)..(465): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtgctatttaaaaggtgtcagtgtgagtgcagctggtggagtccgggggagcttagttcagcctgggggtccctgagactctcctgtgcagcctctggattcaccttcagtagctactggatgcacgtgggtccgaccaagcctccgaaggggagggctgggtgtgggtctcgagtattaatagtgagtgggagtacgacacaagctaacggcggactccggtagaaacggggccattccacctatcnccaagacgacaacgcaaagacagctgatcagacaatgaactagtcagagngaccggaggaactcgggngtgtagtagttacgtgtagacgacgaccgacgaacgtaacgaacgaacgacgacgtacggacggtacggtacggacggaacgg

SEQ ID NO: 437976 - DNA, 568 bp, Homo sapiens
  misc_feature: GZ8MTXP02IAEMI.21.23.C01.1.454.CMB.2.raw
  modified_base (294)..(294): a, c, t, g, unknown or other
  modified_base (455)..(455): a, c, t, g, unknown or other
  modified_base (498)..(498): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcactgggtcccnccaagctccgaggggaagggctgggtgtgggtctcgacgtattaagtagtgagtggggatacgcacaagctacggcggactccggtgaaacgggccgattccaccatcctaccagacgacaacgccaaagaacacgctgtaatctagacaaaatgaaaacngtctaggaagacgaccggaggacacgggctagtgtaattacgngtcgacgaacggccccaagaaccgtagaaacctaacgccaagtcggacgtcgtacggggacaaaacgggg

SEQ ID NO: 437977 - DNA, 565 bp, Homo sapiens
  misc_feature: GZ8MTXP02JXTUG.21.23.C01.1.454.CMB.2.raw
  modified_base (347)..(347): a, c, t, g, unknown or other
  modified_base (391)..(391): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttcctgtgctatttaaaagtgtcagtgtgaggtgcagctggtggagtccgggggagcttagttcagcctgggggtccctgagactctcctgtgcagcctctggattccaccttcagtagctactggatgcacgtggtccgccaagctccgaggggaagggctggtgtgggtctcacgttataatagtgagtgggagtagcanaagctacgcggactccgtagaacgggccgatcacatcaccaganacaacgccaaagaacacgctagtactctgacaaatgaaactagtctaggagaacgcccggaagaccgtaagggtcgtagtagttacgttacgtacgtacgacgaaccggacccgaacgaacgtaacgaaccgtaacgacgtacgtacggacggtacggtacgggacggaaacgg

SEQ ID NO: 437978 - DNA, 652 bp, Homo sapiens
  misc_feature: GZ8MTXP02G705Y.21.23.C01.1.454.CMB.2.raw
  modified_base (549)..(549): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtcctgagactctcctgtgcagcctctggattcacttcagtagctactggatgcacgtcgggtccgcaagctaccgaggggagggctgggtgtggtctcgacgttattaataggtgagtgggagtacgcacaagctaacgacggactccggtagaacggggccgtattccaacatccctacccgaagaacgaacccaaaccggacccaaaaagtaacccaccggacttaggtaactccgtaagaacctaaaagttgaaaacctggttaccagggaaacgacggacccgaagggaccacggggtcttaggtagtaactttacgnggtacggaccaaaaccggggccccctaaaggtaaaccgtcgggaaaacctcgacccgtaaggtacggggaaccgttccggaggggggaaaccaaaaccggggg

SEQ ID NO: 437979 - DNA, 681 bp, Homo sapiens
  misc_feature: GZ8MTXP02FP091.21.23.C01.1.454.CMB.2.raw
  modified_base (540)..(540): a, c, t, g, unknown or other
  modified_base (576)..(576): a, c, t, g, unknown or other
  modified_base (594)..(594): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcacgtcgggtccgaccaagccgtaccgagggggaaggggctggggtggtggggtctacgacgttattaagtaggtgagttggggagtacgaccaacgaaggccttaacggccgggtaactcccggggtaggaaacgggggtccctaatttcccgaacctactcccgtacccgaaggaaccgaaacccgaaaaccggacccaaaagggtaaacccaccggtaccttagttacttccgagaacctaaaagtcgaaaaccngttaccagggaagacgcccggaaggaccgacgggtntagtacgttacttacggngtacgaccgaaaccggtacccaaagtaaccgtacggaaacctaaccgacgtaggtaccgggacgtcgggacggggaacgtaaacggg

SEQ ID NO: 437980 - DNA, 599 bp, Homo sapiens
  misc_feature: GZ8MTXP02HBV0U.21.23.C01.1.454.CMB.2.raw
  modified_base (404)..(404): a, c, t, g, unknown or other
  modified_base (407)..(407): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctactggatgcacgtcgggtcccgccaagcctaccgaggggaaggggcgtggtaaggtgggtctctacgtattaatagtgagtggggagtacgcacgaagctacgcggactccgtaggaagggccgattcacntcncagacgacacgacaagacacgctagtactctgacaaatagaacagtctaggagacgcccggaaggacgacggtctaggtacgttaagtttacgtgtacggacgaaaccggaccccgaaagtaaccgtacggaaaccgtaacccgacgtaacgtacgggaaccggtcggtaacgggggaccgaaaaccggggg

SEQ ID NO: 437981 - DNA, 698 bp, Homo sapiens
  misc_feature: GZ8MTXP02JBZUL.21.23.C01.1.454.CMB.2.raw
  modified_base (251)..(251): a, c, t, g, unknown or other
  modified_base (610)..(610): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggaggtccgggggaggctttagttcaggccgtgggggtccctgagactctctgtgcngcctctggattcaccttcagtagctactggatgctacgtcgggtcccgccaagccgtaccgagggggaaggggcgtggggtggtggggtctacgtaacggttaatttaaagtaggtgtaggtaggggagtacggactaacgaagaccgtaccggaccgggtaactcccggggtagggaaacgggggtacccgtaatttacccaacccgattcccgacccgaagaacgaaacccaaacccggacccgaaaagaaacccaccggaccttagtataccgtagaaccaaaagtacgaaaacgtaggtctaggaagaacggacccggaagggaccacggggtcttaggtagttaactttacggnggtacgaacccgaaaccggacccaaagtaaccgtacggaaacctccgacgaacggtcgggaacgtcgggaccgggaaacgaaaccggg

SEQ ID NO: 437982 - DNA, 550 bp, Homo sapiens
  misc_feature: GZ8MTXP02H7XFH.21.23.C01.1.454.CMB.2.raw
  modified_base (396)..(396): a, c, t, g, unknown or other
  modified_base (479)..(479): a, c, t, g, unknown or other
tcagtcgtcgctcgcacgaccggtgctcgatttagtacacgtgattagggattgggggcccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagcctgggggtccctgagactctcctgtgcagcctctggattcaccttcagtagctactggatgcacgtgggtccgccaagctccgaggggagggctgggtgtggggtctcgacgttattaagagtgagtggggagtagcaacgaagctacgcggactccggtgaagggccattccacatcnccagacgacaacgaccaaagaacacgctgtatctagacaaatgaacagtcagagacgccgaggacacggctgtagtattacgngtacgacaaacggccccaagaccgtaggaacctaacgccaagtcggacgtcggtaggggacgaaaaccggg

SEQ ID NO: 437983 - DNA, 634 bp, Homo sapiens
  misc_feature: GZ8MTXP02HAZPT.21.23.C01.1.454.CMB.2.raw
  modified_base (474)..(474): a, c, t, g, unknown or other
  modified_base (528)..(528): a, c, t, g, unknown or other
tcagtcgtcgctcgcacgaccggtgctcgatttagtacacgtgattagggattgggggccccagccctgggattcccagctgtttctgcttgctgatcaggactgcacacagagaattcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattccaccttcagtagctacgtggatgcacgtcggggtcccgccaaggcctccgagggggaggggctgggtggtgggtctcgacgttattaagtagtgagtgggagtagcacgaagctacggcgggactccggtaggaacgggccgtattccaccatccaccagaacgaaccaaccgaccaaagaccacggctgtaactctagacaaagtcgaaacngttacaggaagacgccggtaaggaccacgggtcttaggtagttaacgtttacgnggtagacccgtaaaaccggggcccccaaaggtaacccgtagggaaaaccctaacggccgtaaaggtcggggaaccgttcggacggggggaactaaaaacccggggg

SEQ ID NO: 437984 - DNA, 552 bp, Homo sapiens
  misc_feature: GZ8MTXP02JEDCX.21.23.C01.1.454.CMB.2.raw
  modified_base (419)..(419): a, c, t, g, unknown or other
  modified_base (468)..(468): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggtttccttgttgctatttaaaaggtgtccagtgtgaggtgcagctggtggagtccggggagcttagtcagcctgggggtcctgagactctcctgtgcagcctctggattcaccttcagtagctactggatgcactgggtccgccaagctccgaggggaagggctggtgtgggtctcacgtattaatagtgatgggagtagcacaagctacggcgactccggtagacgggccgattcacctatcctccagacacaacgccaaagacacgctagtacnctagacaaatgaacagtcaggacagccgagacaggctagtcgtattacngtagacaaacggccccaagaaactcgggaaaacctcgaccctaaggtacgggacgttaccggacgggggaacaaaaaccggggg

SEQ ID NO: 437985 - DNA, 561 bp, Homo sapiens
  misc_feature: GZ8MTXP02FT2NC.21.23.C01.1.454.CMB.2.raw
  modified_base (276)..(276): a, c, t, g, unknown or other
  modified_base (294)..(294): a, c, t, g, unknown or other
  modified_base (397)..(397): a, c, t, g, unknown or other
  modified_base (416)..(416): a, c, t, g, unknown or other
  modified_base (425)..(425): a, c, t, g, unknown or other
  modified_base (442)..(442): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtccctgagactctcctgtgcagcctctggattcaccttcagtagctacnggatgcacgtgggtcccnccaagctccgaggggaagggctggtgtgggtctcacgtattaagtagtgagtgggagtacgcacgaagctacggcggactccgtgaacgggccattcacatcncagacacaacgcaaagacncgctagtancgtagacaaatgaaacngtcaggaagacgccggaaggaccacgggctagtagttattacgtggtcacgaacggcccctaaggaacctcggaaacctcgcctaaggtcggacgttcggacgggggacaaaaccgggg

SEQ ID NO: 437986 - DNA, 554 bp, Homo sapiens
  misc_feature: GZ8MTXP02GN8PI.21.23.C01.1.454.CMB.2.raw
  modified_base (372)..(372): a, c, t, g, unknown or other
  modified_base (392)..(392): a, c, t, g, unknown or other
  modified_base (415)..(415): a, c, t, g, unknown or other
  modified_base (448)..(448): a, c, t, g, unknown or other
  modified_base (478)..(478): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagtcagccgtgggggtccctgagactctcctgtgcagcctctggattcaccttcagtagctactggatgcacgtcgggtccgccaagctccgaggggagggctggtgtggtctcacgtattaatgtgagtgggagtacgcacaagctacgcggactccggngaacgggccattccacatcncagacgacaacgaccaaagaacncgctagtactctagacaaatgaacagtcagganacgcggaaggcacgggctgtacgtattacnggtcacgaaacggccccaagaacctggaaacctaacggacacggtacggacgtcggacggggaacaaaaccggggg

SEQ ID NO: 437987 - DNA, 530 bp, Homo sapiens
  misc_feature: GZ8MTXP02JWSBC.21.23.C01.1.454.CMB.2.raw
  modified_base (427)..(427): a, c, t, g, unknown or other
  modified_base (431)..(431): a, c, t, g, unknown or other
  modified_base (468)..(468): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagcctgggggtccctgagactctcctgtgcagcctctggattcaccttcagtagctactggatgcacgtgggtccgccaagctccgaggggagggctggtgtgggtctcacgtattaatagtgagtgggatagcacagctacgcggactcgtggaacggccatcacatctcagacacaacgccaaagacacgctgtatctgacaaatgaacngtcngagacggaccgagacacggcttaggtgtattacgtgngacgaaacggccccaagaacctggaaacctcgacagtcggacgtcgtacggggacaaacggg

SEQ ID NO: 437988 - DNA, 545 bp, Homo sapiens
  misc_feature: GZ8MTXP02HAXLM.21.23.C01.1.454.CMB.2.raw
  modified_base (409)..(409): a, c, t, g, unknown or other
  modified_base (473)..(473): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcacttcagtagctactggatgcactgggtccgccaagctccgaggggagggctggtgtgggtctcgacgtattaatagtgatggggatagcacaagctacgcggactccggtgaagggccattccacatctccagagacaacgcaagaacncgctagtatctgacaaatgaacagtctagaagacgccgaggtacacggtctgtgtaacttacgngtagacgtaaacggccccaagaaaccgtggaaacctaacgccaagtcggacgtcgtcggggacaaaacgggg

SEQ ID NO: 437989 - DNA, 605 bp, Homo sapiens
  misc_feature: GZ8MTXP02GD3UL.21.23.C01.1.454.CMB.2.raw
  modified_base (435)..(435): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctcctgtgcagcctctggattcaccttcagtagctactggatgcacgtcgggtcccgccaagcctccgaggggagggctggtgtgggtctcgacgttattaagtagtgagtggggagtacgcacaagctacggcgacgtccgtaggaacgggcctattccaccgatcctacagacgaccaacgccaaagacacgntagtactctagaacaaatgaaactgtctaggaagacgaccggagacgacgggtctaggtagttaattacgtggtacgaccgaaacgggcccccaaaaggaacccgtagggaaaccctaacggcccgtaagttccgggaaccggtacgtacgggggaacaaaacccggggg

SEQ ID NO: 437990 - DNA, 549 bp, Homo sapiens
  misc_feature: GZ8MTXP02JZ32T.21.23.C01.1.454.CMB.2.raw
  modified_base (291)..(291): a, c, t, g, unknown or other
  modified_base (442)..(442): a, c, t, g, unknown or other
  modified_base (481)..(481): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagccgtgggggtccctgagactctcctgtgcagcctctggattcaccttcagtagctactggatgcacgtgggtccnccaagctccgaggggagggctggtgtgggtctcgacgtattaatagtgagtgggagtacgcacaagctacgcggactccggtagaacgggccgattccaccatctaccagacgacaacgccaaagacacgctgtatctgacaaagtgaacngtcaggagacgccgaggacacgggctgtagtacttacgngtacgacgaaacggccccaagaacctggaaacctcggccaagtcggacgtcgagggggacaaacgggg

SEQ ID NO: 437991 - DNA, 562 bp, Homo sapiens
  misc_feature: GZ8MTXP02GJ6A4.21.23.C01.1.454.CMB.2.raw
  modified_base (403)..(403): a, c, t, g, unknown or other
  modified_base (409)..(409): a, c, t, g, unknown or other
  modified_base (417)..(417): a, c, t, g, unknown or other
  modified_base (473)..(473): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagtcagccgtgggggtccctgagactctcctgtgcagcctctggattcaccttcagtagctactggatgcacgtcgggtcccaccaagcctaccgaggggaaggggctgggtggtgggtctcgtaacgtattaagtagtgagtgggatagacacaagctacgcgactcgagaaggcatcacatcaccaganacaacncaaagacncgctgatctagaactaaaatcgaaaactgtctaggaagacgccgaagtacacggtntagtatatacgtgtacgacgaaacggacccaagtaaccgcggaaaccaacggaccaagtacgggacgtcggacggggaacaaaacgggg

SEQ ID NO: 437992 - DNA, 545 bp, Homo sapiens
  misc_feature: GZ8MTXP02JA7Z8.21.23.C01.1.454.CMB.2.raw
  modified_base (474)..(474): a, c, t, g, unknown or other
  modified_base (478)..(478): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaaggtgtccagtgtgaggtgcagctggtggagtccggggaggcttagttcagcctgggggtccctgagactctcctgtgcagcctctggattcaccttcagtagctactggatgcactgggtccgccaagctccgaggggaagggctggtgtgggtctcgacgtattaatagtgatgggagtagcacgagctacgcggactccggtgaagggccgattccacatctaccagacgacaacgccaaagacacgctagtatctgacaaatgaacagtctagagacggccgaggacacggctgtagtacttacnggtnacgaaacggccccaagaacctggaactaacggccaagtcggacgtcgtacggggactaaaaccgggg

SEQ ID NO: 437993 - DNA, 620 bp, Homo sapiens
  misc_feature: GZ8MTXP02HDH4G.21.23.C01.1.454.CMB.2.raw
  modified_base (483)..(483): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggaggcttagttcagccgtgggggtccctgagactctcctgtgcagcctcgtggattccaccttcagtagctacgtggatgcacgtggtccgcaagcctccgaggggaaggggcgtggtggtgggtctcgacgttattaagtagtgagtggggagtagcacgagactacgcggactccgtggaaggccattcacatcacagacacacgcaaagacacgctagactcgtagacaaaagtgaaaactgtactaggaacgagacccggaaggacgaccgggtnttaggtagttaactttacggtcggttcggaaaccgaaccggggaacccccaaaggtaaacccgtacgggaaacctaaccggccctaaaggttccgggaaaccgttccgggtaacgggggaacgtaaaaacccggggg

SEQ ID NO: 437994 - DNA, 619 bp, Homo sapiens
  misc_feature: GZ8MTXP02G4TND.21.23.C01.1.454.CMB.2.raw
  modified_base (264)..(264): a, c, t, g, unknown or other
  modified_base (529)..(529): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggagcttagttcagccgtgggggtccctgagactctctgtgcagcctctggattcaccttnagtagctactggatgcacgtcgggtcccaccaagccgtaccgaggggaacggggtcgtggggtggtcgggtctacgtacgttattaagtggtgagtaggggtatacggacaagaacgccgtacggccggactccggtagaacggggcctattaccacgatccacagaacgacaacgaccaaagacacgtctagtactcagacaaaagtgaaactgtacaggaagcggacccgaaggaccgaacggtcttaggtgttaaacttcgnggtacgaccgaaccggacccaagtaaaccgtacgaaaccgtaacgaccgtaaggtacggaccgtacgggtaacggggaaaccgaaacggg

SEQ ID NO: 437995 - DNA, 719 bp, Homo sapiens
  misc_feature: GZ8MTXP02IAXOV.21.23.C01.1.454.CMB.2.raw
  modified_base (616)..(616): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttaattttaaaaggtgtccagtgtgaggtgcagctggtggaggtccgggggagcttagttcagccgtgggggtccctgagctctctgtgcagcctctggacttccaccttcagtagctacgtggatgcacgtcgggtcccaccaagccgtaccggaagggggaacggggtcgttggggttggtcgggttctacgtaacgttaatttaaagtaggtagagtaggggagtacgaccaacgaacggccgtaacggccggtaccgttccggggtacggaaacgggggtcccgtaatttacccgaaccgattcccgtacccgagaaccgaaaccaaaccgacccaaaaggaaaccacggtacttagtaactccgtagaaacctaaaagttacggaaaaccgtgttaccgtagggaacgacggaccggaagggaccgacgggtcttaggttagttaactttacgnggtacgaccgaaaccggaccccaagtaaaccgttcgggaaaaccctaacgacccgtaaggttacgggaaccggttcggtaacgggggaaaccaaaacccgggg

SEQ ID NO: 437996 - DNA, 586 bp, Homo sapiens
  misc_feature: GZ8MTXP02FF3DS.21.23.C01.1.454.CMB.2.raw
  modified_base (274)..(274): a, c, t, g, unknown or other
  modified_base (371)..(371): a, c, t, g, unknown or other
  modified_base (385)..(385): a, c, t, g, unknown or other
  modified_base (387)..(387): a, c, t, g, unknown or other
  modified_base (392)..(392): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggaggcttagttcagcctgggggtccctgagactctcctgtgcagcctctggattcaccttcagtagctacnggatgcacgtgggtcccgccaagcctaccgaggggaagggctggtgtgggtctcacgtattaatagtgagtgggatagcacaagctacgcgactcgngaaggcgatcacancncaganacaacgccaaagacacgtctgtatctgacaaaagtgaaaccagtactaggaagacggacccggaagggaccgtacgggcttaggtgttaaacttacgtgttcgaacgaaaaccgggcccccaaagggtaaacctcggggaaaacctaaccggaccaagtccggggaacgtcggacgggggaccaaaaaccgggg

SEQ ID NO: 437997 - DNA, 560 bp, Homo sapiens
  misc_feature: GZ8MTXP02FJXKU.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagctctcctgtgcagcctctggattcaccttcagtagctactggatgcactcggtccgccaagctccgaggggaagggctggtgtgggtctcacgtattaatagtgagtgggatacgcacaagctacgcggactccgtagaacgggccgattccaaccatcctaccagacgaccaacgaccaaagaacacgctgtatcgtgacaaagtgaaacctagtctaggagacgacgaggacacgggactgtgtaattacgtgtgaccaacggaccccagaaactggaaacctaacgacctagtcgggacgtcgacggggacaaaacgggg

SEQ ID NO: 437998 - DNA, 665 bp, Homo sapiens
  misc_feature: GZ8MTXP02GT36E.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccggggagcttagttcagccgtgggggtcctgagactctcctgtgcagcctctggattcacttcagtgctactggatgcacgtcgggtccaccgaagcctaccggaggggaacggggcgttgggtggtcgggtctcgacgttaattaagtagtgagtggggatacgacacgaagctacgacggtactcgggtagaaacgggtccgtattccgaaccactccctaacgaggaacgaacgaaaccgaccaaaagaaacccacggtacttagtaactaccgtaggaaacctaaaagtgaaaaccgtacgtctaagggaacgaccgaccggaaggaccgaacggtcttaggtacgttaacttacgtcggacgaccgaaacccggccccgtaagtaaccgtacgggaaaacctaacccggtcaacggtacgggtaaccgtcggggtaacggggaaaccgtaaaacccgggg

SEQ ID NO: 437999 - DNA, 529 bp, Homo sapiens
  misc_feature: GZ8MTXP02F27XS.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccggggagcttagttcagcctgggggtccctgagactctcctgtgcagcctctggattcaccttcagtagctactggatgcactggtccgccaagctccaggggaagggctggtgtgggtctcacgtattaatagtgatgggatagcacaagctacgcgactccgtgaaggccattcacatctccagagacaacgccaaagaacacgctgtatctgacaaatgaacagtctagagacgccgaggacacggctagtgtatacgtgtcgacaaacggccccaagaacctggaaacctcgccaagtcggacgtccggtaggggacaaaacgggg

SEQ ID NO: 438000 - DNA, 580 bp, Homo sapiens
  misc_feature: GZ8MTXP02FOBR8.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagcctgggggtccctgagactctcctgtgcagcctctggattcaccttcagtagctactggatgcactgggtccgccaagctccaggggaagggctggtgtgggtctcacgtataatagtgatgggatagcacaagctacgcagctccgtgaagggccattcaccatctcagagaacacgaccaaagacacgctgtatctagacaaatgaaactagtacgtagaacggacgacccggaaggaaccgacgggccttaggtacggtaatttaaccgtgtacgaccgaaacggcccccgaaagtaaccgtacgggaaaaccttaccggaccctaggtcggtaacggtccgtagggggaaaacccgg

SEQ ID NO: 438001 - DNA, 583 bp, Homo sapiens
  misc_feature: GZ8MTXP02IE7U4.21.23.C01.1.454.CMB.2.raw
  modified_base (287)..(287): a, c, t, g, unknown or other
  modified_base (504)..(504): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaggtgtccagtgtgaggtgcagctggtggaggtccgggggagcttagttcagccgtgggggtccctgagactctcctgtgcagcctctgattcacttcagtagctactggatgcacgtggccncaagctccgaggggagggctggtgtggtctgacgtattaatagtgagttggggagtacgactacgaagccgtaacggccggactccgggtaggaaacgggcccgtattccacctagtcctaccagacgacaacgcctaaagacacgtctgtactcgagactaaaagtgaaactgtctaggagcggacgaggtacacgggtcttggtagtatttacgngtacgaccgaaccggacccaagaccgtacggaaacctaacggactaacggtcgggacgtcgggtacgggaaccgaacgg

SEQ ID NO: 438002 - DNA, 563 bp, Homo sapiens
  misc_feature: GZ8MTXP02JIIBO.21.23.C01.1.454.CMB.2.raw
  modified_base (508)..(508): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcagcctctggattcaccttcagtagctactggatgcacgtcgggtccgcctaacgcctaccgagggggaacggggtcgtgggtggtcgggtctcgacgttattaagtagtagagtggggagtacgcacgaagctacgcagctccgtaggaacgggccattcacatcctaccagacgacaacgacccaaagaccacgtctagtactcctagaccaaagtcgaacagtcagacgagccggaggacacggctgtatactacgngtacgaccgaacggcccaagactacggaactcgcagtggaccgtcgagggaaccg

SEQ ID NO: 438003 - DNA, 686 bp, Homo sapiens
  misc_feature: GZ8MTXP02IWTQZ.21.23.C01.1.454.CMB.2.raw
  modified_base (475)..(475): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctcctgtgcagcctctggattccaccttcagtgctactggatgcacgtcgggtcccgaccaagccgtaccgagggggaacggggcgtggggtggtcggggtctacgtaacgttaattaagttaggtgaggtggggagtagacacgaagcgtacgcggactccggtaggaacgggccgtattccaaccgtatcctaccaagaacgaccgaacgaccaaagaaccacgactagtacnctagaaacctaaagtacgaaactgtaccgtagggaacgacggacccggaaggaaccgacggtccgttaggtacgttaactttacggtcggttaggaacccgtaaaccgggacccccgtaaagtaaaaccggtacggtaaaacccgtaaccggcccgtaaaggtccggggtaaaccgtcggggtaaacgggggaaccgtaaaaacccggggg

SEQ ID NO: 438004 - DNA, 644 bp, Homo sapiens
  misc_feature: GZ8MTXP02FWLTK.21.23.C01.1.454.CMB.2.raw
  modified_base (473)..(473): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggtacttcaccttcagtagctacgtggatgcacgtcgggtcccgaccaagccgtaccggagggggaacggggcgtgggtggtgggtctcgtacgtaattaagtagtgagtggggagtacgcacgaagcgtacggcggacgtccggtaggaaacgggccgtacttaccgaacctactacctaccgaaggaaccgaaccaaaaccgcccaaaagaaaccncgtactagtaactctagaaactaaaagtcgaaactgtcaggaagacggcgaaggtacacgggtctaggtataagttacgtggtacgaccgtaaaccggcccaaaggtaaacccgtggaaaaccctcggacctaggtcgggaccgtacgggacgggggaaccaaaacggggg

SEQ ID NO: 438005 - DNA, 601 bp, Homo sapiens
  misc_feature: GZ8MTXP02IZIDF.21.23.C01.1.454.CMB.2.raw
  modified_base (515)..(515): a, c, t, g, unknown or other
tcagtcgtcgctcgcacgaccggtgctcgatttagtacacgtgattagggattgggggccccagcccgtgggattcccagctgtttctgcttgctgatcaggactgcacacagagaactcaccatggagtttgggctgagctgggttttccttgttgcttattttaaaaggtgtccagtgtgaggtgcagctggtggaggtccgggggagtcttagttcacgccgtgggggtccctgagactctctgtgcagcctgtggattccaccttcagtagctacgtggatgcacgtcgggtccaccaagctcgaggggaagggctggtgtggtctctacgtattagtagtgagtgggagtacgcgtacgaagtcgtacgcggtactcggtagaacgggccgtacttaccacatcgtaccgagacgaaccaacgacccaaaagtaccgacgtcttagtaactcgtagaacaaagttcgaaacctagtccgtagacgtacgacgaggacgtacggctaggtnttacttcgtagtcgacgaaaccggtcccaaggtaacgtcgaaacctcggacctaagtcgggacgttcggacggggacaaaccgggg

SEQ ID NO: 438006 - DNA, 724 bp, Homo sapiens
  misc_feature: GZ8MTXP02H8X15.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggagcttagttcagccgtgggggtccctgagactctcctgtgcagcctctggattcacccttcagtagctactggatgcacgtcgggtcccgaccaacgccgtacccggaagggggacggggtcgtggggtggtcgggttcttacgtacgtttaatttaaagtaggtaggtaagtggggtagtacgacgtaaacgaacgtaccgtacggccgggtaccgtcccggttaaggggaaacggggtacccgttaacttacccgaaccctattaccctacccgaaaggaaaccgaaacccaaccggaacccgaaaacggtaaccacgcttaagtactctaggaaactaaatagaaacgtagttacgaggaagaacggcccgaaagggaccgacgggtgttacggttagtttaacgtttaccgaggttcgaaccgaaaccggtaccccgaaagtaaaccgtaccggaaacctaaccgcgtacggttacggggaccgttacgggacgggggaacccaaaacggggg

SEQ ID NO: 438007 - DNA, 625 bp, Homo sapiens
  misc_feature: GZ8MTXP02F9GPN.21.23.C01.1.454.CMB.2.raw
  modified_base (436)..(436): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccggggaggcttagttcagccgtgggggtcctgagactctcctgtgcagcctctggattcaccttcagtagctactggatgcacgtgggtcccgccaagctaccgaggggaagggctggtggtgggtctcacgtattaagtagtgagtggggagtacgacacgaagctacggcgactccggtaggaacgggccgattccaccatctaccagaacgaccgaaacgcctaaagaaaccncggtactagtacactagaaccaaaagtcgaaactagtacgtaggaagacggacccgaaaggaccaacgggtcttagtagtaagtttaaccgtggtacgaccgaaaccgggacccaaggtaaaaccgtggaaaaccgtaaccgaccgtaggtaccgggtacgtacggacgggggaaacgaaaacccgggg

SEQ ID NO: 438008 - DNA, 526 bp, Homo sapiens
  misc_feature: GZ8MTXP02FYP5U.21.23.C01.1.454.CMB.2.raw
  modified_base (391)..(391): a, c, t, g, unknown or other
  modified_base (394)..(394): a, c, t, g, unknown or other
  modified_base (421)..(421): a, c, t, g, unknown or other
  modified_base (436)..(436): a, c, t, g, unknown or other
  modified_base (462)..(462): a, c, t, g, unknown or other
  modified_base (496)..(496): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcacgtgggtccgccaagctccgaggggagggctggtgtgggtctcgacgtattaagtagtgagtggggatacgcacaagctacgcggactcggtgaaggccgattcacntcncagacacaacgacaagacacgctgtanctagacaaatgaacngtcagagacgccgagacgcgctagtntactacgtgcgaacacggacccagacgtgaaccncgcagtacggacgtcggacgggacgaacgg

SEQ ID NO: 438009 - DNA, 569 bp, Homo sapiens
  misc_feature: GZ8MTXP02JZAR4.21.23.C01.1.454.CMB.2.raw
  modified_base (469)..(469): a, c, t, g, unknown or other
  modified_base (500)..(500): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctactggatgcacgtgggtccgccaagctccgaggggaacgggctggtggtgggtctcgacgtattaagtagtgagtggggagtagcaagaacgctacggcggactccggtagggaacgggccgattccacctatcctaccagaacgacaaccgaccaaagacacgctcgaatcctgacaaagtgaacagtcaggaanacggtccgaaggacaggctagtagtattcgngtcgacaacggccccaagaaccgtacggaactcgccaagtcggaccgtcggtacgggggacaaacgggg

SEQ ID NO: 438010 - DNA, 612 bp, Homo sapiens
  misc_feature: GZ8MTXP02G1ZRN.21.23.C01.1.454.CMB.2.raw
  modified_base (319)..(319): a, c, t, g, unknown or other
  modified_base (393)..(393): a, c, t, g, unknown or other
  modified_base (415)..(415): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtccctgagactctcctgtgcagcctctggattcacctttcagtagctactggatgcactgggtccgccaagcgtccaggggaagggctgggngtgggtcctgacgttataagtgagagtgggagtacgacacagcgtacgcggactccggagacgggcctatcacntcacagacacaacgcaaagacncgtactgtatccgtagaacaaagtacgaaacgtcgttacgagggaaagacccgaccgggtaaaggaccgaaccgggttcgttaggttacgttaagttacgtacggacgaaccgaacccggaccctaaacggtaaccgtaacggaaccgccgacgtacggtacggggtaccgtacgggaccggggaaacgaaaccggg

SEQ ID NO: 438011 - DNA, 604 bp, Homo sapiens
  misc_feature: GZ8MTXP02G4AZ9.21.23.C01.1.454.CMB.2.raw
  modified_base (254)..(254): a, c, t, g, unknown or other
  modified_base (295)..(295): a, c, t, g, unknown or other
  modified_base (425)..(425): a, c, t, g, unknown or other
  modified_base (432)..(432): a, c, t, g, unknown or other
  modified_base (467)..(467): a, c, t, g, unknown or other
  modified_base (472)..(472): a, c, t, g, unknown or other
  modified_base (490)..(490): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtgggggtccctgagactctctgtgcagcctntggattccacttcagtagctacgtggatgcacgtgggtccnccaagctccgaaggggaagggctgggtggtggtctacgacgttattaatagtgagtgggagtacgcacgaagctacgcggactccggagaacggccatccacatccacagacgacaacgcaaagacacgntgaatcngaacaaatgaactagtcagacgacgaccgaggacncggtnttagtagtaactttacgnggtacgaaccggtaaacggacccccaaaggtaaacccgtaaggaaaaccctaacggacccgtaaggttacggggaaaccgtttcccgggaaggggggtaaaccaaaaccggggg

SEQ ID NO: 438012 - DNA, 531 bp, Homo sapiens
  misc_feature: GZ8MTXP02FYK02.21.23.C01.1.454.CMB.2.raw
  modified_base (388)..(388): a, c, t, g, unknown or other
  modified_base (393)..(393): a, c, t, g, unknown or other
  modified_base (408)..(408): a, c, t, g, unknown or other
  modified_base (410)..(410): a, c, t, g, unknown or other
  modified_base (416)..(416): a, c, t, g, unknown or other
  modified_base (418)..(418): a, c, t, g, unknown or other
  modified_base (421)..(421): a, c, t, g, unknown or other
  modified_base (426)..(426): a, c, t, g, unknown or other
  modified_base (431)..(431): a, c, t, g, unknown or other
  modified_base (452)..(452): a, c, t, g, unknown or other
  modified_base (463)..(463): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagcctgggggtccctgagactctcctgtgcagcctctggattcaccttcagtagctactggatgcacgtggtccgccaagctccgaggggaagggctggtgtgggtctcacgtattaatagtgagtgggatagcacaagctacgcggactccgtgaacgggcatcacatcncaganacaacgcaagaaccncntagtcnanaanaaagngaacngtcaggagacgcgagacgcgntagtatatcgngacgacgaaccgacccaagaacgtacgaacctcgacgtagtcggacgtacggacgggaacgaaacggg

SEQ ID NO: 438013 - DNA, 554 bp, Homo sapiens
  misc_feature: GZ8MTXP02IW68Z.21.23.C01.1.454.CMB.2.raw
  modified_base (295)..(295): a, c, t, g, unknown or other
  modified_base (372)..(372): a, c, t, g, unknown or other
  modified_base (480)..(480): a, c, t, g, unknown or other
  modified_base (488)..(488): a, c, t, g, unknown or other
  modified_base (493)..(493): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattccacttcagtagctactggatgcacgtcgggtccncaagctccgaggggagggctggtgtgggtctcgacgttattaagtagtgagtgggatacgcacagctacggcgtacncggtgaaacggggccagttccaacatctccgagacgacaacgcctaaagaaccacgctagatcagacaaatgaactagtcagacgacgccgtagacctaggctaggtntaattcgngtacncgaaacggcccaagaacgtcggaaactcgaccagtcggacgtcgacgggggacaaaacggg

SEQ ID NO: 438014 - DNA, 699 bp, Homo sapiens
  misc_feature: GZ8MTXP02GHVH1.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtgggggtccctgagactctcctgtgcagcctctggattcaccttcagtagctacgtggatgcacgtgtcgtcccgccaagcctaccggaggggaaggggcgtgggtgtgggtctacgtacgtattaatagtgagtgggagtagacacgaacgcgtaaccggcggaccgtccggtaggaaacggggtccctaactttcccgaaaccacttccctaccgaaacggaacgaaaccaaaccgacccgaaaaggaaacccacgtacgttacgtactactacggaaccaaaagttacgaaacctaggtacgtaggacggaacgtacccgggaacgggtaaccaacggggtccttaggtagtttaacgttacgttcggacgtaaaccggaaacccggtaccccgaaaacggtaacccgtacggggtaaaccttaaccggaccgttaaacggtcgggtaaccggttacggaacgggggaaaacccgg

SEQ ID NO: 438015 - DNA, 546 bp, Homo sapiens
  misc_feature: GZ8MTXP02GBUVY.21.23.C01.1.454.CMB.2.raw
  modified_base (391)..(391): a, c, t, g, unknown or other
  modified_base (410)..(410): a, c, t, g, unknown or other
  modified_base (414)..(414): a, c, t, g, unknown or other
  modified_base (425)..(425): a, c, t, g, unknown or other
  modified_base (470)..(470): a, c, t, g, unknown or other
  modified_base (484)..(484): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagtcagccgtgggggtccctgagactctctgtgcagcctctggacttcaccttcagtagctactgatgcacgtcgggtcccaccaagcctaccgaggggaagggcgtgggtgtgggtctcgacgttattaagtagtgagtgggatacgcacagctacgcgactcgagaggcatcacatcncagacacaacgcaaagacncgtntagtactacgngaaacaaagtagaactgtcaggacgacgaccggaggacgacggtnttagtatacttcgngacgacgaaccgccaagaccgtacgaacctcgacgtacgcggacgtcggacgggacgaacgg

SEQ ID NO: 438016 - DNA, 639 bp, Homo sapiens
  misc_feature: GZ8MTXP02IED7Y.21.23.C01.1.454.CMB.2.raw
  modified_base (531)..(531): a, c, t, g, unknown or other
  modified_base (550)..(550): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagtcttagttcaggccgtgggggtccctgagactctctgtgcagcctctggattccaccttcagtagctacgtggatgcacgtcgggtcccgccaagcctaccggagggggaacggggctggggtggtcggggttctacgtaacgttaattaagtaggtagtagtggggagtacgacaacgaagcgtaacggccgggacctccgggtaggaacgggcccgtattccacctatccgaccgaagaacgaacaaacgaccaaaagacacgctagtactctagactaaagtgaaactagtctaggagacggacggaaggaccgacggtntaggtacgttactttacgngtacggaccaaaacgggccccaaaggaaccgttacgaaaaccgtaaccgctaaggtcgggaccgttcggacggggaacgaaaaccgggg

SEQ ID NO: 438017 - DNA, 580 bp, Homo sapiens
  misc_feature: GZ8MTXP02HPM6C.21.23.C01.1.454.CMB.2.raw
  modified_base (275)..(275): a, c, t, g, unknown or other
  modified_base (298)..(298): a, c, t, g, unknown or other
  modified_base (343)..(343): a, c, t, g, unknown or other
  modified_base (425)..(425): a, c, t, g, unknown or other
  modified_base (433)..(433): a, c, t, g, unknown or other
  modified_base (438)..(438): a, c, t, g, unknown or other
  modified_base (479)..(479): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggaggtccgggggaggcttagttcaggccgtgggggtccctgagactctctgtgcagcctctggacttccaccttcagtanctactggatgcacgtgggtcccncaagctaccgaggggagggcgtggtgtgggtctcacgttattaanagtgagtgggatagcacagcgtacgcggactcggtaggaacggcctattccaccgatccacagacaacaacgaccaagaacncgactgancgtanaacaaatagaactagtagaggacgacgacggagacgcggtntagtattatacgtgtacgacgaaccggacccaaggaaccgtacggaaacctaaccgacgtaacggtaccggtacggtacgggaacggggtaacgaaaccgg

SEQ ID NO: 438018 - DNA, 646 bp, Homo sapiens
  misc_feature: GZ8MTXP02HRXHP.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtgggggtccctgagctctcctgtgcagcctctggattccaccttcagtagctactggatgcacgtcgggtcccgccaagctccgaggggaagggctgggtgtgggtctcgtaacgttattaataggtgtagtgggagtacgcaacgagctacgccggactccggtagaacgggccgtattaccgacattccaccaagaacgaacaacgacccaaagtaaccacgtctagtactcgtagactaaaagtcgaaactagttcagggaagacggtacccggaaggaccgtaacgggttgttaggttagttaacgtttacggtggtacggaaccgtaaaccggaacccaaaggtaaaccgtcggtaaaacctaaccgacgtaacggtacggggaccgtacgggtaacggggaaaaccggaaaaccggg

SEQ ID NO: 438019 - DNA, 613 bp, Homo sapiens
  misc_feature: GZ8MTXP02HNWZK.21.23.C01.1.454.CMB.2.raw
  modified_base (364)..(364): a, c, t, g, unknown or other
  modified_base (433)..(433): a, c, t, g, unknown or other
  modified_base (515)..(515): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtgggggtcctgagactctcctgtgcagcctcgtggattcaccttcagtagctacgtggatgcacgtcgggtccacaagcctacgaggggagggcgtggtggtggtctcgacgttaataagtgtgagtgggagtacgacaanagcgtacggccggactccggtaggaacgggcctattccactatccacagacacaacgccaaagacacgntagactcgagaacaaagtgaaactagtcaggaacgacgaccggtaaggaccgtacgggtcttaggtacgttaactttacggnggtaccgaaccgaaaccggacccgaaaggtaccgtaacggaacctaaccggacgtaacggtacgggaccggtcgggtaacggggaaaccgaaaccggg

SEQ ID NO: 438020 - DNA, 598 bp, Homo sapiens
  misc_feature: GZ8MTXP02JSB4F.21.23.C01.1.454.CMB.2.raw
  modified_base (529)..(529): a, c, t, g, unknown or other
  modified_base (559)..(559): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcacgtcgggtcccgccaagcgtccgaggggaaggggcgtgggtggtgggtctcgacgttatttaagtaggtagagtggggagtacgacacaagctacggcggactccggtagaacgggccgtatccaccgactccgtaccgaagacgaaccaaacgccaaaagacccacggtcttagtaactcgtagaacaaaattgaactagtcgaggaagacgacggaggacacggtcgtagtagtatttacggngtacgacgaacgcccgaagacgtacgaacnccgacgtacgtacggacgtacggacgggaacgaaacggg

SEQ ID NO: 438021 - DNA, 645 bp, Homo sapiens
  misc_feature: GZ8MTXP02HSV4S.21.23.C01.1.454.CMB.2.raw
  modified_base (269)..(269): a, c, t, g, unknown or other
  modified_base (478)..(478): a, c, t, g, unknown or other
  modified_base (504)..(504): a, c, t, g, unknown or other
  modified_base (536)..(536): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttattttaaaaggtgtccagtgtgaggtgcagctggtggaggtccgggggagtcttagttcaggccgtgggggtccctgagactctcctgtgcagcctctgattcaccttnagtagctactggatcgcacgtcgggtccccgactaacgccgtaccggaagggggtaagggccgttagggtggtcgggtctacgtaacgtttattaagtaggtgtagtggggatacgacgaacgagcgtacggccggtactccgggaaggaacgggccgtacttccgaacctactccaccgaaagaccgaaccaaccgactaaaacgacnccggatacgtacactagaaacaaatnaaacgtgtcgagacgacgacgacgacgacgtnttagtagtacttagcgtacgaccgaaccgggcccaagtaaaccgacggaaaccaaccggccgtaaaggtccgggaacgttaccgggaacggggaaccgaaaacccgggg

SEQ ID NO: 438022 - DNA, 661 bp, Homo sapiens
  misc_feature: GZ8MTXP02GERA2.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctgtggacttcaccttcagtagctacgtggatgctacgtcgggtcccgaccaagccgtacccgaagggggaacggggtcgttggggttggtcggggttacctacgtaacggttaattaagtaggtaggagtaggggagtacgacacgaagctacggcgtacgtccggtagaaacgggggcctagttccaaccgtatcctaccgaagaacgaaccaaaccgaccaaaagaaccacgactagtactacgtagaaacaaatagaaactagtactaggagaaccgaccggaaggaccgaacggcttagtagttacttacgtggtacgacgaaaccggacccgaaacgtaacgtacggtaaaccgtccgaaccacggtacggaccggtacggtacgggggaacaaaacccggggg

SEQ ID NO: 438023 - DNA, 581 bp, Homo sapiens
  misc_feature: GZ8MTXP02GXFJS.21.23.C01.1.454.CMB.2.raw
  modified_base (417)..(417): a, c, t, g, unknown or other
  modified_base (431)..(431): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtcagtgtgaggtgcagctggtggagtccggggagcttagtcagccgtgggggtcctgagactctcctgtgcagcctctggattcaccttcagtagctactggatgcacgtgggtcccgcaagcgtccgaggggaagggctgggtgtgggtctcacgtataagtagtgagtgggatacgcacaagctacgcgactccgagaacggcgattcacatcaccagacgacaaacgcaaagactacgctganctgacaaatgaacngtacagagacgccggagacgacggctaggtgtaaacttacgtggtacgacgaaaccgggcccccaaggtaaaacgttacgggaaaaccttaaccggcccaaaaggttcggggaaccgtttacgggaccgggggaacgaaaaacccggggg

SEQ ID NO: 438024 - DNA, 671 bp, Homo sapiens
  misc_feature: GZ8MTXP02JBX6J.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcacgtcgggtccgccaagcgtaccgaggggaagggcgtgggtgtgggtctcgacgttattaagtgtgagtggggagtacgacacgaagccgtacggcggtactccggaggaacgggccgtattccaccatcctaccgagacgaccaacgaccaaagacacgctagtatctagaacaaaagttcgaaacgtacgtacgtaggaacggaccggaccggaaggggacccgacgggtacttacgggttagttacgtttaacgtcggttacggacccgtaaaccggacccccgtaaaggtaaacccggtacggtaaaaccgtaaccggaaccccgtaggttaccgggggtaaccggtttaccgggtaacggggggaacccgtaaaacccggggg

SEQ ID NO: 438025 - DNA, 576 bp, Homo sapiens
  misc_feature: GZ8MTXP02HDTZF.21.23.C01.1.454.CMB.2.raw
  modified_base (501)..(501): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagccgtgggggtccctgagactctcctgtgcagcctctggacttcacccttcagtagctactggatgcactggtccgcaagctccgaggggaaggggctgggcgtggggtctcgacgttattaaatagtgagtgggagtacgacaacaagctaaccggcggaactccgtagggaagggccgtattcactatcctaccagacacaaacgccaaagaacacgctagtatctgaacaaatagaacagtctggaagacgccgaaggacacgggtctagtgtaattacggngtacgacgaaaccggacccaacgaacgtacgaaacctaaccgcaacgtcggtacgtcggaacgggaacgaaacgg

SEQ ID NO: 438026 - DNA, 609 bp, Homo sapiens
  misc_feature: GZ8MTXP02H57I7.21.23.C01.1.454.CMB.2.raw
  modified_base (261)..(261): a, c, t, g, unknown or other
  modified_base (317)..(317): a, c, t, g, unknown or other
  modified_base (329)..(329): a, c, t, g, unknown or other
  modified_base (412)..(412): a, c, t, g, unknown or other
  modified_base (427)..(427): a, c, t, g, unknown or other
  modified_base (481)..(481): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtgctatttaaaggtgtcagtgtgaggtgcagctggtggagtccgggggagcttagttcagccgtgggggtcctgagctctctgtgcagcctcgtgattctaccttcagtanctacgtggatgcagtcggccacaagctccggaggggagggctgggtggtgggtctnacgttattaagngtgagtgggatacgacaacagctacggcgactccgtaggaacgggcctagtcacatccaacgagagactaacgactaagaacncgtctatactcgaanaaactaaagtacgaaacgtgtacgaggaagcggaaccgtaaggaccgtacggtnttaggtacttaacgttcggaggaccgaaaccgaaaccggtacccaaaaggtaaccgtaaccggtaaccaaccggtacgtaacgggtacgggtaaccggtacgggaacggggaaaacgtaaacccgggg

SEQ ID NO: 438027 - DNA, 618 bp, Homo sapiens
  misc_feature: GZ8MTXP02JUMUP.21.23.C01.1.454.CMB.2.raw
  modified_base (253)..(253): a, c, t, g, unknown or other
  modified_base (381)..(381): a, c, t, g, unknown or other
  modified_base (430)..(430): a, c, t, g, unknown or other
  modified_base (519)..(519): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggagtccgggggagcttagttcagccgtgggggtccctgagactctcctgtgcagcctntggattcaccttcagtagctacgtggatgcacgtgggtcccgaccaagcctccgaaggggaggggctggtggtggtctcgacgttattaatagtgagtggggatacgacacaagctacgcggactcgngaacgggccagttccacatctaccgagacgaacaacgaccaaagaaccncggacttagtactcgtagaaacctaaatgaaacgtagtctagggacgacggaccgaaggacgacggtcttaggtagtaacttacgtggngaacccgaaaccgggacccccaaaggtaaacccgtcgggaaaacctaaccggcccgtaagtcggggtaacgtccgggacgggggaaacaaaaccggggg

SEQ ID NO: 438028 - DNA, 588 bp, Homo sapiens
  misc_feature: GZ8MTXP02GGLWG.21.23.C01.1.454.CMB.2.raw
  modified_base (443)..(443): a, c, t, g, unknown or other
  modified_base (522)..(522): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaaggtgtccagtgtgaggtgcagctggtggaggtccgggggaggcttagttcagccgtggggggtccctgagactctcctgtgcagcctctggattcaccttcagtagctactggatgcacgtcgggtcccgaccaagcctccgaggggaagggcgtgggtgtggtctcgacgttattaagtagtgagtgggagtacgcacgaagctacggccggactccgggtagaacggggcctattccaccgtatcctaccgagacgaccaacgaccaaagaaccncgactgtatcctagaacctaaatagaaactagtcgtaggaacgacggaccgaaggacacgggcttagtagtacttacgngtacgacgtacggacccagaacgtggaacctaacgacagtcggacgtcggtacgggacgaaacggg

SEQ ID NO: 438029 - DNA, 627 bp, Homo sapiens
  misc_feature: GZ8MTXP02GD9TC.21.23.C01.1.454.CMB.2.raw
  modified_base (436)..(436): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcacctttcagtagctactggatgcacgtgggtccgaccaagcctacgaggggagggctgggtgtggggtctcacgtattaagtagtgagtgggatacgcacgagctacggcggactccggtaggaacgggccgtattccaccgtatcctaccagaacgacaaaccgcaaagaaccncggctagtacttcagaacctaaagcgaaacagtactaggacgacggaccgtaaggaccgtaacgggcttagtagttaactttacggtggtacgacccgaaacgggacccccaaaggaaaccgttaggaaaaccctccggaccgaaggttaccgggaccggttcggaaccgggggaaccggaaaaccggggg

SEQ ID NO: 438030 - DNA, 557 bp, Homo sapiens
  misc_feature: GZ8MTXP02FS7DQ.21.23.C01.1.454.CMB.2.raw
  modified_base (293)..(293): a, c, t, g, unknown or other
  modified_base (376)..(376): a, c, t, g, unknown or other
  modified_base (418)..(418): a, c, t, g, unknown or other
  modified_base (424)..(424): a, c, t, g, unknown or other
  modified_base (426)..(426): a, c, t, g, unknown or other
  modified_base (434)..(434): a, c, t, g, unknown or other
  modified_base (436)..(436): a, c, t, g, unknown or other
  modified_base (444)..(444): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtagctactggatgcactgggtccnccaaagctccgaaggggaagggctggtgtgggtctcacgtattaatagtgatggggagtacgcacaagctaagcggactccgngaaggccattcacatcacagagacaacgccaaagaacacgtntagacncngaacaaananaacagtanagagacgacgagacgacgcgtgtagtattactagtagacgaaacgacccgaacgaaacgtaacgaaaccgaaccgaccgacgtacggacggtacggtacgggaacggaaacgg

SEQ ID NO: 438031 - DNA, 671 bp, Homo sapiens
  misc_feature: GZ8MTXP02FOJTO.21.23.C01.1.454.CMB.2.raw
  modified_base (599)..(599): a, c, t, g, unknown or other
  modified_base (631)..(631): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggattcaccttcagtactctacgagatcgctacggtccggtccgacgacgtccgtacgggaaggggacggtcgtgggtggtcggtctacgtaagttaaattaaggtagtagtaggtagggtagtaccgacaacgacgtacgacggtaccggtacgtcgggaacgggaacggggtacctacttaccgaactaccgttcccgaaaccgaggaaacccaaaccgaacccgaaaccgtaaaacgaaacccgccgttagttaacgtacgtacgtacgaaaacttaaagacgaaacgtcgttagaacggaggaccgacggtaacgacggtacgtgtagttagtaacttgngacgaacgaccggtaccaagtacgacgtaacnccgactaggacggtacgtacgggacggaacgtaaacccgg

SEQ ID NO: 438032 - DNA, 633 bp, Homo sapiens
  misc_feature: GZ8MTXP02FXIKL.21.23.C01.1.454.CMB.2.raw
  modified_base (469)..(469): a, c, t, g, unknown or other
  modified_base (480)..(480): a, c, t, g, unknown or other
  modified_base (535)..(535): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtccctgagactctcctgtgcagcctctggattcaccttcagtagctactggatgcacgtcgggtccgccgaagcctaccgaggggaacgggtcgtgggtggtgggtctacgacgtattaagtagtgagtgggatacgcaacgaagcctacggccggtactccgggtaggaaacgggccgtattccgaacctactcccgtacccgaaaggaaccgaaaccaaaccggacccaaaagtaaaccncgtctagtaanccgtagaaccaaaagtcgaaactgtacagggaagacgccggaaggacacgggttnttagtattacttacgtgacgaaccgaaccggacccaaagtaaccgtacggaacctaacggacgtaggtacggtacgtcggacggggaaacaaaccggg

SEQ ID NO: 438033 - DNA, 637 bp, Homo sapiens
  misc_feature: GZ8MTXP02GWUNU.21.23.C01.1.454.CMB.2.raw
  modified_base (260)..(260): a, c, t, g, unknown or other
  modified_base (275)..(275): a, c, t, g, unknown or other
  modified_base (552)..(552): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttaattttaaaaggtgtccagtgtgaggtgcagctgggtggaggtccgggggaggtcttagttcagccggtgggggtccctgagactctcctgtgcagcctntggtattccaccttnagtagctacgtggatgcacgtcgggtcccaccgaagccgtaccggaagggggaacggggtcgttggggtggtcggggttcctacgtaacgttaatttaaagtaggtagagtggggatacgacaacgaagctacggccggtactccgggtaggaacggggcctattccacctactcctaccgaagaacgaaccaaaccgaccaaagaaccaccgcttagtactcctagaaacaaagtagaaactgttcaggaagacggaccggaaggaccgacggttntagtattacgtcgtgacgaccgaaccgacccgaagtacgacgaactaacgacgtacggtacggacgtcgggacgggaacgaacgg

SEQ ID NO: 438034 - DNA, 750 bp, Homo sapiens
  misc_feature: GZ8MTXP02IP4LF.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggagcttagttcagccgtgggggtcctgagactctctgtgcagcctctggacttcaccttcagtagctacgtggatgcacgtcgggtcccgaccaacgtccgtaccggagggggaacggggcgtgggtggtcggggtctacgtaacgttattaagtagtgtagtgggtagtacgactaacgaacgcgtacggccggaccgtccggtacggaacggggtaccgtacttcccgaacctacttacccgtaacccgagtaaaccggaaaccaaaccggacccgaaaagaaccccgaacgtcttaacgttaactcccgtaaggaaaccctaaaagtacgtaaaccggagttacccgtagggaaacgaccggaaccggaaacgggtaaccgaccgggtacttagggttagttaactttaaccggtcggtagaaaccccggaaacccgggacccccaaaaggtaaaacccgttccggaaaaccgtaacccggacccgtaaagggtaccggggaaccggttccgggtaacgggggaacccgaaaaaccggggg

SEQ ID NO: 438035 - DNA, 623 bp, Homo sapiens
  misc_feature: GZ8MTXP02HLTAC.21.23.C01.1.454.CMB.2.raw
  modified_base (270)..(270): a, c, t, g, unknown or other
  modified_base (460)..(460): a, c, t, g, unknown or other
  modified_base (508)..(508): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtcctgagactctcctgtgcagcctctggattccacttcagtanctactggatgcacgtcgggtcccgcaagccgtaccgaggggaaggggtctgggtggtgggtctcgacgttattaagtaggtgagtggggatacgacacaagctacggcggactccggtaggaacgggccgtattccaacctataccctaccaagaacgaacaaccgacaaaacgaacacgactagtaacnctagaacaaatagaaactagtacaggagacgaccggaagacgaccggnttaggtatacttacgtgtacgaccgaaacggtaccccaaggtaaccgtacggaaaaccgtaacgacccgaaaggtcggggaaccgttcgggacgggggaaccgaaaacccggggg

SEQ ID NO: 438036 - DNA, 529 bp, Homo sapiens
  misc_feature: GZ8MTXP02F5BR4.21.23.C01.1.454.CMB.2.raw
  modified_base (291)..(291): a, c, t, g, unknown or other
  modified_base (411)..(411): a, c, t, g, unknown or other
  modified_base (419)..(419): a, c, t, g, unknown or other
  modified_base (433)..(433): a, c, t, g, unknown or other
  modified_base (455)..(455): a, c, t, g, unknown or other
  modified_base (466)..(466): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagcctgggggtccctgagactctcctgtgcagcctctggattcaccttcagtagctactggatgcactgggtccnccaagctccgaggggaagggctggtgtgggtctcacgtattaatagtgagtgggatagcacaagctacgcggactccgtgaagggccgattcacatctacagagacaacgccaaagaacncgctgtanctgacaaatgaacngtctagagagccgagacacggntgtgtattacngtgacaacggccccaagaacctggaaactcgaccagtcggacgtcgtaggggacaaaacgggg

SEQ ID NO: 438037 - DNA, 653 bp, Homo sapiens
  misc_feature: GZ8MTXP02GUKQT.21.23.C01.1.454.CMB.2.raw
  modified_base (425)..(425): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggaggcttagttcagccgtgggggtccctgagactctcctgtgcagcctctggattcaccttcagtagctacgtggatgcacgtcgggtccgccaacgctccgaggggagggctggtgtgggtctacgacgttattaagtagtagtagtggggagtacgacaacaagccgtacggccggactccgggtaggaaacggggcccgtattccgaacctattaccncccgaaaggaacgaacccgaaacgcccaaaagaaacaccgtactaggtactaccgtagaaacctaaaagttacgaaacgtaggttaccagggaacgaacggacccggaaggaccgaacggtcttaggtacgttaattaccgtggtacgaaacaaaacggccccctaaaggaaacctacggaaacctaacgcctaagttcggaacgttcggacggggacaaaaccgggg

SEQ ID NO: 438038 - DNA, 654 bp, Homo sapiens
  misc_feature: GZ8MTXP02GK0XI.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagcgtggtggaggtccgggggagtcttagttcagccgtgggggtccctgacgctctcctgtgcacgtcctcgtggtacttccaccttcagtagctacgtggatgcctacgtcggtcccgaccgaagtccgtacggaggggacggtggtggtggtcggtctacgtagttataagtgtagtaggtggatacgacacgacgaccgtacggaccgtacgtcggacggacggtacgtactaccactactaccgaacgagaaaccgaccaaaccgaccgtaaagaccgtcgtagtacttacgactaacgaaactaagaccgtaagtcgtacgaggacgacgaccgggaatacggtagttccggttagttaacgtcgttagtcgggtaaccaaccgggaccgaccgtaaacgtaccggacgtaaccgcccggagtacggtacggtacgtacggggacgggaaaccggtaacccggg

SEQ ID NO: 438039 - DNA, 715 bp, Homo sapiens
  misc_feature: GZ8MTXP02H9SXI.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagtcgttgggttttccttgttgtcttaattttaaaaggtgtccagtgtgaggtgcagcgtgggtggaggtccgggggagtcttagttcacggtccgtgggggtccctggacgtactctcctgtgcagcctcgtggtattcctaccttcagtacgctacgtggatgccacgtcgggtccaccaagcgtaccggaggggaacgggtcgtgggtggtcgggtcctacgtaacgttaattaaagtagtgagtggggaagtacgacaacgaagtcctacggacggtacgtccgtagggaaacggtccgtattccaacactacctacccgaagacgaaccaacgaccaaaagaccacgctagtaactcgtagaaacaaagtcgaaactgtacgtaggaaacgacggtaccggaacggaaccgtacggggtcttacggtttagttaactttacggtaggttaccgaccggtaaaacccggacccccgtaaaggtaaacccgtaacggttaaaccgaaccggtacccgtaaagggtcgggtaacccggtttaccggggtaacgggggaaaacccgaaacccggggg

SEQ ID NO: 438040 - DNA, 601 bp, Homo sapiens
  misc_feature: GZ8MTXP02HOMGL.21.23.C01.1.454.CMB.2.raw
  modified_base (296)..(296): a, c, t, g, unknown or other
  modified_base (518)..(518): a, c, t, g, unknown or other
  modified_base (535)..(535): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtcctgagactctcctgtgcagcctctggacttccaccttcagtagctacgtggatgcacgtcgggtccncgaagccgtccgagggggaagggcgtgggtggtgggtctcgacgttaattaagtaggtagagtggggatacgacaacagcgtacggccggtactccgggtaggaacgggccgtagttccaacctatccaccgaagacgaaccaaacgcaaaagacacgatgtactcgtagaacaaagttcgaaactagttcgaggacgaacggaccggaaggaccgacggtntggttactagtttacgngtacgaccgaccgaccagtaccgtacgaactcgacgtacggtcggacgtcggacgggaacgaacgg

SEQ ID NO: 438041 - DNA, 550 bp, Homo sapiens
  misc_feature: GZ8MTXP02F0CS3.21.23.C01.1.454.CMB.2.raw
  modified_base (255)..(255): a, c, t, g, unknown or other
  modified_base (428)..(428): a, c, t, g, unknown or other
  modified_base (431)..(431): a, c, t, g, unknown or other
  modified_base (437)..(437): a, c, t, g, unknown or other
  modified_base (485)..(485): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctggagactctcctgtgcagcctntggattcaccttcagtagctactggatgctacgtcgggtcccgaccaagcctaccgagggggaaggggctgggtgtcgggtctcgaacgtattaagtagtgagtgggagtacgcacgagctacgcgactcggtgaacgggccgattcacatcaccagacacaacgacaagacncgntagtanctgacaaatgaacagtcagagacgcgaggacaggctagtgtaatacgngtgacgacgacccagaaacgtcgaaacctaacgccgtagtcggacgtcgacgggacgaaaacggg

SEQ ID NO: 438042 - DNA, 672 bp, Homo sapiens
  misc_feature: GZ8MTXP02I8DLG.21.23.C01.1.454.CMB.2.raw
  modified_base (253)..(253): a, c, t, g, unknown or other
  modified_base (299)..(299): a, c, t, g, unknown or other
  modified_base (473)..(473): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctatttaaaaggtgtccagtgtgaggtgcagctggtggaggtccgggggagcttagttcagccgtgggggtccctgagactctcctgtgcacgcctntggtattccaccttcagtagctacgtggatcgctacgtcgggtccnccgaacgccgtccgagggggaacgggtcgtgggtggtgggtctcgtaacgttattaagtgtagtagtgggtagtacgacaacgaagcgtaacggccggaccgtcggtaggaccgggaccgtataccaccgtacttccgaccgaagacgaaaccgaaaccgtaccaaagaaaccncggtacttaggtactaccgtagaaactaaacttcggaaaaccgtgttccgaggaaacggcggaccggagaacgtcggtcgttagtagttacgttactgggtacgaaccggaaacggcccccgaaagtaaccgtacggaaaccctaacgacccgtaagtcggggtaccggttcgggaacgggaacggtaaaaacccgggg

SEQ ID NO: 438043 - DNA, 614 bp, Homo sapiens
  misc_feature: GZ8MTXP02IRK14.21.23.C01.1.454.CMB.2.raw
  modified_base (539)..(539): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagcgtggtgggaggtccgggggaggctttagttcagccgtgggggtccctgagactctcctgtgcagcctctggattcaccttcagtagctacgtggatgcacgtcgggtcccaccgaacgccgtaccgaggggaacggggtcgtgggtggtcgggtctcgtacgttaattaagtaggtgagtagggagtacggacaacgagcgtacgccggactccgggtagaacgggtccgtacttccgactatccacgagacgaactaacgccaaagacacgtctagtactcagaactaaaagtgaaactgtccgaggacgacggaccgaagggacacggtcttagtagttactttacgngtacgcgaaaccggcccaagtaaccgtgaaaccgtcgcaaggttcggacgtttacggcggggaaccgaaaccggg

SEQ ID NO: 438044 - DNA, 615 bp, Homo sapiens
  misc_feature: GZ8MTXP02FQ3DT.21.23.C01.1.454.CMB.2.raw
  modified_base (296)..(296): a, c, t, g, unknown or other
  modified_base (501)..(501): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgttcagtgtgaggtgcagctggtggaggtccgggggagcttagtcagccgtgggggtccctggagactctcctgtgcagcctctggacttcaccttcagtagctactggatgcacgtcgggtcccncaagctaccgaggggagggctgggtgtggtctctacgtattaataggtagagtgggagtacgacaacaagcgtaacgccggactccggtagaacgggccgattccacatctacagacgaccaacgcctaaagacacgctagtactcgtagactaaaatggaaactagtctaaggacgtacggacccggagggaacccgcgggttnttaggtaagttaacgttacgtggtaccgaacggtaaaccggacccaaacggtaacgtacgaaaccgtccgactacggtacgggtacgtacggacgggggaacctaaaacggggg

SEQ ID NO: 438045 - DNA, 623 bp, Homo sapiens
  misc_feature: GZ8MTXP02ITL28.21.23.C01.1.454.CMB.2.raw
  modified_base (254)..(254): a, c, t, g, unknown or other
  modified_base (294)..(294): a, c, t, g, unknown or other
  modified_base (360)..(360): a, c, t, g, unknown or other
  modified_base (452)..(452): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttcctgttgctattttaaaaggtgtccagtgtgaggtgcagctggtgggaggtccgggggaggcttagttcagccgtgggggtccctgagactctcctgtgcagcctntggattcaccttcagtagctactggatgcacgtgggtccnccaagctccgaggggaaggggctgggtgtgggtctcgacgttattaatagtgagtgggagtagcanagctacgcggactcggtagaacgggccgattccacatctccagacacaacgcaaagacacgctagtaatccgtagaactaaaatcgaaaacngtactaggaacgacgacccggaagggccgaacgggtcttaggtagttaacgtttacgtggtacgaccgtaaaaccggggccccctaaagggtaaacccgtcggggtaaaaccctccggaccctaaagggttcggaaccgttcgggtaacgggggaaccgtaaaaccggggg

SEQ ID NO: 438046 - DNA, 647 bp, Homo sapiens
  misc_feature: GZ8MTXP02H8IZY.21.23.C01.1.454.CMB.2.raw
  modified_base (126)..(126): a, c, t, g, unknown or other
  modified_base (152)..(152): a, c, t, g, unknown or other
  modified_base (223)..(223): a, c, t, g, unknown or other
  modified_base (289)..(289): a, c, t, g, unknown or other
tcagtcgtcgctcgcacgaccggtgctcgatttagtacacgtgattagggattggggccccagccctgggattcccagctgtttctgcttgctgatcaggactgcacacagagaactcaccatggngtttgggctgagctggtttctgttgntatttaaagtgtcagtgtgagtgcagctggtgagtcggggagctagttcagccgtgggggtcctgagctcnctgtgcagctctgatcacttcagtgctactggatgcactggtcgcaacgcgtccgagggaaggggngtggtggtggtcgtacgtagtaataagtagtagtagtaggtaggacgacgaacgaacgacgtacgacggacgtcgtacggaacggaccgtactaccaccactaccaccgacgaacgaacgaacgaacgaaacgaaacgacgacgtacgtactacgtacgtaacgaaacgtaaacgaaacgtaacgtacgtaacggaaggaacggaaccggaacggaacggacggtacgttagttacgttaacgttaacgtacggtacggtaaccggaaaccggaacccgtaaacgtaacgtaacggtaaaccgtaaccgtaccgtaacggtacggtaccggtacgggtaacgggaaacgggaaaccgg

SEQ ID NO: 438047 - DNA, 670 bp, Homo sapiens
  misc_feature: GZ8MTXP02F86MF.21.23.C01.1.454.CMB.2.raw
  modified_base (297)..(297): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtccctgagactctctgtgcagcctctgtacttcaccttcagtagctacgtggatgcacgtcgggtacccncgaagccgtaccggaggggaacgggtcgtggtggtcgggtctacgtacgttaattaagtagtgagtggggagtacgacacgagcgtacggccggtacgtccgggtacggaacggggtccgtacttccgaactactccacccgaagaaccgaaacccgaaacgacccgaaaagtaacccaacgtcttagtactaccgaagaacctaaaagtgaaaccgtgttaccgagggaacgacgacccgggtaagacccgaggtccttggtacgttaacgttcggtagaccggaaccgaaaccgggaccccgtaaagaaccgtaacggtaaccaacgaccgtaggtacgggtacggtacgggacggggaaacgaaaccggg

SEQ ID NO: 438048 - DNA, 616 bp, Homo sapiens
  misc_feature: GZ8MTXP02IP7EQ.21.23.C01.1.454.CMB.2.raw
  modified_base (297)..(297): a, c, t, g, unknown or other
  modified_base (439)..(439): a, c, t, g, unknown or other
  modified_base (520)..(520): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtgggggtccctgagactctcctgtgcagcctctggtattccaccttcagtagctactggatgcacgtcggtccnccaagctccgaggggagggctggtgtggtctcagttattaagtagtgagtgggagtagacacaagctacggccggacttccggtaggaaacgggccgtattcccgactatcctaccgagacgaccaaacggaccaaagaacncgtctagtactcagactaaagtcgaaactgtcaggaacgacgcccggaaggaccacgggtcttaggtataacgtttaccgnggtacgaccgaaaaccgggccccaaaggaaacctcgggaaaacctccggaactacggttacgggaccgtacggtacgggggaaccaaaaccggggg

SEQ ID NO: 438049 - DNA, 626 bp, Homo sapiens
  misc_feature: GZ8MTXP02F2WFS.21.23.C01.1.454.CMB.2.raw
  modified_base (250)..(250): a, c, t, g, unknown or other
  modified_base (471)..(471): a, c, t, g, unknown or other
  modified_base (547)..(547): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtggggggtccctgagactctcctgtgcngcctctggattcacccttcagtagctactggatgcacgtgggtcccgaccaaagctaccgagggggaacggggcgtggggtggtcggggtcctacgaacggtaattaaagtaggtgagtggggatacgactaacgaagctacggcggtacgtccgggtgaaaggggcctattccacctagtcctcccgaagaacgaaccgaaacgacccaaaagtaaaccncgtactagactctacgacaaaagtcgaaaactagtctaggagacgccgaaggacacggtctagtagtacttacggngtacgaccgaaacggaccctaagtaaccgtggaaaacctcgacgtaagtcgggacgtacggacggggaacgaaacgggg

SEQ ID NO: 438050 - DNA, 606 bp, Homo sapiens
  misc_feature: GZ8MTXP02F26QS.21.23.C01.1.454.CMB.2.raw
  modified_base (251)..(251): a, c, t, g, unknown or other
  modified_base (428)..(428): a, c, t, g, unknown or other
  modified_base (453)..(453): a, c, t, g, unknown or other
  modified_base (456)..(456): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggtttttccttgttgcttaattttaaaaggtgtccagtgtgaggtgcagcgtggtggaggtccgggggagtcttagtcagccgtgggggtccctgagctctctgtgcngcctgtggacttccaccttcgagtacgctacgtggatcgctacgtcggtacccaaccgaacgcgtaccggaggggacgggcgtgggtggtgggtctacgtaacgttattaagtagtgagtgggagtacgacaacgacgcgtacggccggacttcggagggaacggcgtactccactntcacgagacgacaacgacaaagacncgntagactcgagaacaaagtgaacgtgtccgtagggaacgacggccgaagaccgaggtcttaggtattactagcggtacacggaaccgacccaagtaacgtacgaaaccgtcgacgtaggtaccggtacggcggaacggggactaaaccggg

SEQ ID NO: 438051 - DNA, 677 bp, Homo sapiens
  misc_feature: GZ8MTXP02JUPHQ.21.23.C01.1.454.CMB.2.raw
  modified_base (259)..(259): a, c, t, g, unknown or other
  modified_base (557)..(557): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttaattttaaaaggtgtccagtgtgaggtgcagctgggtggaggtccgggggagtcttagttcaggccgtgggggtccctgacgactctctgtgcagcctntggattcaccttcagtagctactggatgcacgtcgggtcccgaccaagcctaccgaggggaaggggcgtgggtggtgggtctacgacgttattaagtggtagtagtggggatacgacacgaagctacggcggactccgggtaggaacgggcccgtattcccgaacctactacctaccgaaggaacgaaacccaaccggacccaaaagaaccaccgaccttagtaactctagaaacctaaaagttacgaaaccgtgtaccgtagggaagaacggacccgggaaggaaccggaccggttnttaggttagttaactttacgtggtacgaccgaaaccggtcccccaaaggtaaaccgtcggaaaccttccggaccctaaggtaccggggacgtacgggtcgggggaaactaaacccggggg

SEQ ID NO: 438052 - DNA, 579 bp, Homo sapiens
  misc_feature: GZ8MTXP02FZXF6.21.23.C01.1.454.CMB.2.raw
  modified_base (463)..(463): a, c, t, g, unknown or other
  modified_base (466)..(466): a, c, t, g, unknown or other
  modified_base (489)..(489): a, c, t, g, unknown or other
  modified_base (524)..(524): a, c, t, g, unknown or other
  modified_base (549)..(549): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctcctgtgcagcctctggacttcaccttcagtagctactggatgcacgtcgggtccgaccaagccgtaccgagggggaacgggtcgtgggtcggtggggtctcgtaacgttattaagtaggtagagtggggagtacgacacgaagcgtacggccggtacgtccggtaggaacggggcctaagttccaactattccaccgaagacgacaaccgacctaaagacncgnttagatcagaacaaatggaaacngtacagagacgacggagacacggttgtatactcgngagacgacgccaagtacgacgaacncgcaggtcgacgtacggacgggaacaacgg

SEQ ID NO: 438053 - DNA, 623 bp, Homo sapiens
  misc_feature: GZ8MTXP02GK20C.21.23.C01.1.454.CMB.2.raw
  modified_base (252)..(252): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggaggtccgggggaggcttagttcaggccgtggggggtccctgagactctcctgtgcngcctctggattcaccttcagtagctactggatgcacgtgggtccgccaagctccgaggggaaggggctgggtgtgggtctcacgtattaatagtgagtgggatacgacacaagcgtacgccggactccgggtagaacgggccgtattccaccatcctaccagacacaacggaccaaaagtacacggctagtactactggaaactaaagtcgaaacctaggtacctagggaacggacgaccggtaaggaccgacgggtcttaggtacgttaattacgtggtacgaccgaaaccggtaccccaaggaaccgtagggaaacctccggaccgaggttcggggaccgttcgggacggggaaccgaaaacccggggg

SEQ ID NO: 438054 - DNA, 636 bp, Homo sapiens
  misc_feature: GZ8MTXP02JWK8E.21.23.C01.1.454.CMB.2.raw
  modified_base (473)..(473): a, c, t, g, unknown or other
  modified_base (545)..(545): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttcctgttgctattttaaaaggtgtccagtgtgaggtgcagctgggtggaggtccgggggagcttagttcaggccgtgggggtccctggagactctcctgtgcagcctcgtggtacttccaccttcagtagctactggatgcacgtcgggtacccgaccgaagccgtaccggagggggaacggggtccgttggggtggtcggggtccttacgtaacgtttaattaagtaggtagagtagggagtacgacaacgagccgtacggcggactccggtaggacggtcctataccacatccagagacgacaccgacaaagaccgctagtacnctagaaacaaagtcgaactgtctaggacgacggacccgaaggaccgacggtcgttagtagtactttaccggnggaccgaaccggaaccggaccaagtaaccgtaggaaccctaacgacgtacggtacgggtaccgtacggggaacggggaaccgtaaccgggg

SEQ ID NO: 438055 - DNA, 701 bp, Homo sapiens
  misc_feature: GZ8MTXP02GTEHV.21.23.C01.1.454.CMB.2.raw
  modified_base (558)..(558): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccggggagtcttagttcagccgtgggggtccctgagactctctgtgcacgcctctggtacttccaccttcagtagctacgtggatgcacgtcgggtcccacgaagccgtaccggaaggggaacggggcgtagggtcggtcggggttcctacgtacgttaagttaagtagtagagtagggagtacgacgaacgagcgtacggcgtacgtccggtaggaacgggccgtaattccgaactacttccacccgaagaaccggaaccaaaccggaccaaaaggaaccacgtcttagtactcgtacgaaactaaaagtcgaaaacgtgttacgaggaacgacggacccggaaggaccgaacgggtnttagggttacttaacgtttaccgtaggtaccgaacggaaacccggtacccgaaaggtaaacccgtaacggtaaacccgtaaccgaccgtaacgggtacggggtaaccgttacgggggaacgggggaaaccgtaaaacccgggg

SEQ ID NO: 438056 - DNA, 667 bp, Homo sapiens
  misc_feature: GZ8MTXP02JQMMI.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgtgctgagctgggttttccttgttgctattttaaaggtgtccagtgtgaggtgcagctggtggaggtccgggggaggcttagttcaggccgtgggggtccctggagactctcctgtgcagcctgtggattccaccttcagtagctactggatgcacgtcgggtccgaccaagcgtccgaaggggaggggcgtgggtgtggggtctacgtacgttattaagtaggtgaagttgggaacgtacgacgaacgtaacggcgtaaccggcggtaccgtccgggtaggaacgggggtcctaacgtttccaacctactacctaccgaacgaacgaaccgaaaccgaacccgaaacgaaaccgaacgtaccgtacgttacgtacgtacgaacgtaaacgtacgaaacgagtacgtaagacgacggaccggaacggacgaccggtacgtatagggggttacttacgttggtacgacgaccggtacccgacgaaccgtacggaacgtacgaccgacggtacggacggtacggacggggtaaccggg

SEQ ID NO: 438057 - DNA, 697 bp, Homo sapiens
  misc_feature: GZ8MTXP02ILJ9U.21.23.C01.1.454.CMB.2.raw
  modified_base (461)..(461): a, c, t, g, unknown or other
  modified_base (474)..(474): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagttcagccgtgggggtcctgagactctctgtgcagcctctggattcaccttcagtagctactggatgcacgtcgggtccgccaagcctccgaggggaacggggcgtgggtggtgggtctcgacgttattaagtagtgagtggggagtacggcaacgagcttaacggccggactccggtaggaacggggacccgtagttccaaccgtatcctacccgaagaacgaaccaaccggacccaaagaaaacccncgtacttagtacnctacgaaacaaagtacgaacgtaggtaccgtaggaacgaccggaccggaaggtaccgtacgggtagttacgtagttaacgtttaccgtaggtaccggaaacccggtaaacccgggaccccgtaaaggtaaaacccggtacgggtaaaacccttaaccggtacccgtaacgggtaccggggacccggtacgggggtaaaccgggggaaacccgaaaaccggggg

SEQ ID NO: 438058 - DNA, 700 bp, Homo sapiens
  misc_feature: GZ8MTXP02JRHL1.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctaattttaaaaggtgtccagtgtgaggtgcagctggtggaggtccgggggagcttagttcagccgtgggggtccctgagactctcctgtgcagcctctggattcaccttcagtagctactggatgcacgtgggtcccacaacgcctaccgaggggaagggtcgtgggtacggtcgggtctacgtaacgttaattaaagtaggtagaagtggggtaagtacgacaacgaagtccgtaacggaccggacctccgggtagggaaacggggtccctaacttaccgaaccctattcccgaaaccgaaggaaacgaaacccgaaaaccgaccgaaaaacgaaaccttaccggtacgttaagtaattccctaaggaaacctaaaagtacggaaaacctggttacgagggaaaccgtacgaccccgggtaaggaaaccgtcggggtactttagggtaattaacgtttaactggaccgaacgaaaccggccccaaaagaacgtacgaaacctaacgcctaagccgggacgtccggaggggaaccaaaacggg

SEQ ID NO: 438059 - DNA, 635 bp, Homo sapiens
  misc_feature: GZ8MTXP02IMRYA.21.23.C01.1.454.CMB.2.raw
  modified_base (280)..(280): a, c, t, g, unknown or other
  modified_base (309)..(309): a, c, t, g, unknown or other
tcagtcgtcgctcgcacgaccggtgctcgatttagtacacgtgattagggattgggggcccagccctgggattcccagctgtttctgcttgctgatcaggactgcacacagagaactcaccatggagtttgggctgagctgggttttccttgttgcttatttaaaaggtgtccagtgtgaggtgcagctgggtgggaggtccggggggaggcttaggttcaggccgtggggggtccctggacgtacttctcctgtgcacgtcctcgtggattccaccttnagtagctacgtggatgcacgtcgggtccnccaagctccgaggggacgggctgggtgtgggtctcgaacgttattaagtgtgagtgggagtacgacacgaagctacggcgactcggtgacgggcctatccacatccacagacacaacgacaaagacacgtctagtactagtacaactaaaagttgaaacttcggtacgtaggaacgacggacccggaaggacccgaggctttgtacgtacttaacgcggtagaccggaaaccggaccccgaagtaaaaccggtcgtaaaacctaaccggcccgtaaggttacccggggacggtaccggtacgggggaaaaccgtaaaacccggggg

SEQ ID NO: 438060 - DNA, 694 bp, Homo sapiens
  misc_feature: GZ8MTXP02FPQDX.21.23.C01.1.454.CMB.2.raw
  modified_base (256)..(256): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttcctgttgctatttaaaggtgtccagtgtgaggtgcagctggtggaggtccgggggaggcttagtcagccgtgggggtcctgagactctcctgtgcacgtcctcgtggnttcacctttcagtgctactggatgcacgtggtccgaccaagccgtaccgaggggaacgggtcgtgggtcggtgggtctcgaacgttattaagtagtgagtagggtatacggcaacgaagcgtaacggcggaacgttcccgggaggaacgggccgtagttccaacctattccgacgaagaaccaacgaaaccgacccaaaggaaacctcggactagttacacaacgaaactaaaatcggaaacctggttcaagggaacgacggacccgttaaggaacccgtacgggttagttagggtacgttaaacttacggtcggtaacgaaccggtaaaccccggtaaccgaaaacggtaaccgtaaccggtaaccgtaacccggacggtaaacgggtaccggggtaccgggtttaccgggaacgggggaaacccggaaaaccgggg

SEQ ID NO: 438061 - DNA, 557 bp, Homo sapiens
  misc_feature: GZ8MTXP02I06RC.21.23.C01.1.454.CMB.2.raw
  modified_base (290)..(290): a, c, t, g, unknown or other
  modified_base (369)..(369): a, c, t, g, unknown or other
  modified_base (383)..(383): a, c, t, g, unknown or other
  modified_base (475)..(475): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggagtccgggggagcttagttcagcctgggggtccctgagactctctgtgcagcctctggattcacttcagtagctactggatgcactcggggtccnccaagctaccgaggggaagggctggtgtggtctcacgtattaatagtgatgggagtagcacaagctacgcggactccgngaagggccatcacntctacagacgacaacgccaaagaacacgctagtaatctacgacaaagtgaaacagtacgtgaagacggccgaaggaccgacgggcttaggtntaactttacgtgtacgacgaaacgccccagaaaccgtcgaaacgtccggacaagtcggacgttacgcggggaacaaaacggg

SEQ ID NO: 438062 - DNA, 662 bp, Homo sapiens
  misc_feature: GZ8MTXP02GC28T.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtcagtgtgaggtgcagctggtggaggtccgggggaggcttagttcagccgtgggggtccctgagactctcctgtgcagcctcgtggattccaccttcagtagctacgtggatgcacgtcgggtccgaccaagcctaccgaggggaaggggcgtgggtggtcgggtctcgaacgttattaagtaggtgaggtgggaagtacgcaacaagctacggcgactccggagaacgggcctatccactactcacagacgacaacgaccaaagacacgactagtactctagaaacaaatcgaaacgtagtaccgtaaggacgaaccggtaccggaagggaaccgacgggtcttaggtacgttaacttaacggtggtacggaccgtaaaacccgggcccccgtaaaaggtaaacccgtacgggtaaaacccgtaacggacccgtaaacgggtacggggaccggtttacgggtaacgggggaaacctaaaaacccgggggg

SEQ ID NO: 438063 - DNA, 590 bp, Homo sapiens
  misc_feature: GZ8MTXP02F3D3V.21.23.C01.1.454.CMB.2.raw
  modified_base (439)..(439): a, c, t, g, unknown or other
  modified_base (462)..(462): a, c, t, g, unknown or other
  modified_base (486)..(486): a, c, t, g, unknown or other
  modified_base (498)..(498): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcagccgtgggggtccctgagactctcctgtgcagcctctggacttcaccttcagtagctacgtgatgcacgtcgggtcccgaccaagcctaccgagggggaagggctgggtggtcggtctcgtacgtattaagtagtgagtgggatagcagaagctacgcggtactccggtggaaacgggccgtacttccgactatccctacagactaacaacgacaaagacncgtatgatcgagacaaatgaacngtcagagacgcgaggacacgggtntagtagtatcgngacaccggaaccggacccaaggaaccgtacggtaaacccgccgtacgtacggttacgggaccggtacggggacgggaaaccgtaaaccgggg

SEQ ID NO: 438064 - DNA, 593 bp, Homo sapiens
  misc_feature: GZ8MTXP02JMTN2.21.23.C01.1.454.CMB.2.raw
  modified_base (253)..(253): a, c, t, g, unknown or other
  modified_base (267)..(267): a, c, t, g, unknown or other
  modified_base (272)..(272): a, c, t, g, unknown or other
  modified_base (292)..(292): a, c, t, g, unknown or other
  modified_base (356)..(356): a, c, t, g, unknown or other
  modified_base (481)..(481): a, c, t, g, unknown or other
  modified_base (521)..(521): a, c, t, g, unknown or other
  modified_base (556)..(556): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagctggtggaggtccgggggagcttagttcagccgtgggggtccctgagactcctctgtgcacgcctntggattccaccttnagtanctactggatgcacgtggccncaagctccgagggagggctggtgtggtctcgtacgtattaagtgtgagtggagtacgacaaganccgtacgcggactccggtaggaacggtacgtacttcgacctattcccacgtagaaccgaacaaccgacctaaacgaacctcgactagtactcgtacgaacaaagttagaaacctgtacagggaanccggaccgagggaccagggtcttagtacgtaatttacggngacgaacgaacccgaccagtaaccgacggaaaccncgacgtaggtcggaccgtcggaacgggacgtaaccgg

SEQ ID NO: 438065 - DNA, 830 bp, Homo sapiens
  misc_feature: GZ8MTXP02JA5Z4.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggtcttagttcagccgtgggggtccctgagactctcctgtgcagcctctggattccaccttcagtagctacgtggatgcacgttcgggcccgaccaagcgtacccgagggggaacggggcgtgggtggtacggggttctaccgtaacgtttagtttaagtaggttaggaggtaggggtattaacggaccgaacgaaaggtccgttaacgggcccggtaacgttcccccggggttaggggaaaccgggggtaccccggttaactttaccccgaaccctaaccgttacccgttaacccccgaaaggaaccggaaaacccgaaaaccgggaacccccaaaaggaaaacccacccgggtcttacggttaaactccgtaacggaaaccctaaaaagttccggaaaaccgttagttaccgagggaaaacgcgggaccccgggaaagggtacccgaacggggttcttagggtttacgttaacgttttacgtaccgggttacgacggtaaaaccccgggtaccccgtaaaagggtaaacccggttacgggaaaaccccttccgggaccctaaagggtttaccgggggaacccgtttcgggggaccgggggtaaaacctaaaacccgggggg

SEQ ID NO: 438066 - DNA, 672 bp, Homo sapiens
  misc_feature: GZ8MTXP02F5Z9H.21.23.C01.1.454.CMB.2.raw
  modified_base (254)..(254): a, c, t, g, unknown or other
  modified_base (473)..(473): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaggtgtccagtgtgaggtgcagcgtgggtggaggtccgggggagcttagttcaggccgtgggggtccctgagactctctgtgcagcctntgacttcaccttcagtagctactggatgcacgtcgggtcccgaccaacgccgtaccggagggggaacgggcgttgggtggtcgggtctcgaacgttattaagtaggtgagtggggagtacgacaacgaacgcgtacggaccggtacgtccggtagggaacggggccgtacttaccgactacgtcctaccaagaccgaaacaaacggtacgaaacgaacncggtctagtaatcgtagacaaaagtcaaacgtgtacgtaggaacgacggaccggagggaacgtcggtacgttacgtagtttaacttacgtaggtacggaacccgaaacggacccccgtaaggaaaccggttacggaaaacctaaccggaccgaacggttcgggaccggtacggaacgggggaaccgtaaaaacccgggg

SEQ ID NO: 438067 - DNA, 590 bp, Homo sapiens
  misc_feature: GZ8MTXP02HXFK8.21.23.C01.1.454.CMB.2.raw
  modified_base (257)..(257): a, c, t, g, unknown or other
  modified_base (272)..(272): a, c, t, g, unknown or other
  modified_base (299)..(299): a, c, t, g, unknown or other
  modified_base (321)..(321): a, c, t, g, unknown or other
  modified_base (341)..(341): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagcgtggtttctgtgctatttaaagtgtcagtgtgaggtgcagctggtggaggtccgggggagcttagttcagccggtgggggtccctgagactcgtctgtgcagcctgtggatcacttnagtagctatggatgnacgtggccacagctcgaaggggtaggntggtgtggtctcgagttattangtgagtaggagttacccganaacgagtcgtacgcgtacgtccggtaggaacggtcctataccacgtacacgacgaagaaccgaaccacgaacaaagtacgacgtcgtaagtactcgtacgtaactaaagtaacgaacgtagtacgtacgacgacgacggacgacgtacgtagtacgtagttacgttacgtacgtacgacgacgaaccgaaccgaacgtaacgtaacgtaacgacgtacgtacggtacggtacggtacggaacggaacgg

SEQ ID NO: 438068 - DNA, 623 bp, Homo sapiens
  misc_feature: GZ8MTXP02IIB86.21.23.C01.1.454.CMB.2.raw
  modified_base (269)..(269): a, c, t, g, unknown or other
  modified_base (384)..(384): a, c, t, g, unknown or other
  modified_base (436)..(436): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctgggtggaggtccgggggaggtcttagttcagccgtgggggtccctgagactctcctgtgcagcctctggattcaccttnagtagctactggatgacacgtcgggtccgaccaagcctcgaggggagggctgggtgtggtctcaacgttattaagtagtgagtgggatacgacaacgagctacggcgactccggngaacgggccatccacatccaccagacacaacacaaagacacgctagatcganaacctaaagtcaaactagtctaggaacgcggaccggaaaggaccgacgggtacttggtaagtttaacgtttcgaggttaccgaacgtaaacccggggacccccaaaaggtacccgtaacggtaaaccctaacggtcccaaaggttcgggaacggttaccgggaacgggggtaaacccaaaacggggg

SEQ ID NO: 438069 - DNA, 637 bp, Homo sapiens
  misc_feature: GZ8MTXP02HOCSK.21.23.C01.1.454.CMB.2.raw
  modified_base (501)..(501): a, c, t, g, unknown or other
  modified_base (560)..(560): a, c, t, g, unknown or other
  modified_base (578)..(578): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgcttattttaaaaggtgtccagtgtgaggtgcagcgtggtggaggtccgggggaggtcttagttcgaggccgtgggggtccctgacgactctcctgtgcacgcctcgtggacttccaccttcagtacgctacgtggactgctacgtcggtacccgacaacgccgtaccgaagggggagggtcgttgggtggtcgggtctacgtacgtttaattaagtaggtagtaggtaggggtaagtacgaccgacgtaacgtccgtaaccggaccggtacgtcccggtagggaaacgggtccgtacttaccgaccattcccacgaagaccgaaccaaccggtacaaaagaaccncgtactagtacttcgagaaactaaagttcgaaatgtcgagacgacgacggagtaaccgngcttgtagtacttacggngcgaacgaccgacacgtacgtacgactaacgcgtagtcggacgtacggacggacgaacg

SEQ ID NO: 438070 - DNA, 715 bp, Homo sapiens
  misc_feature: GZ8MTXP02GEI5J.21.23.C01.1.454.CMB.2.raw
tcagtcgtcgctcgcacgaccggtgctcgatttagtacacgtgattagggattgggggccccagccctgggattcccagctgtttctgcttgctgatcaggactgcacacagagaactcaccatggagtttgggctgagcttgggttttccttgttgcttaattttaaaaggtgtccagtgtgaggtgcagcgtggtgggaggtccgggggaggtcttagttcaggccggtcgggggtccctgacgactctcctgtgcacgcctctggattccaccttcagtacgctactggatgcacgtcgggccaccaagccgtcggaggggagggtcgtgggtggtgggtctcgtacgttataagtaggtgtagtgggagtacgacaacgaacgtcgtacggaccggtacgtccgggtagggaacgggcccgtacttacccaacctactccctaacccgaagaaacccgaaccgaaacccgtaaccaaaagaacccgcgtacttacgttaactaccgtaagaaacctaaagtacggaaaccgtagtaccgaagggaaacgacccggaccccgggaaaggtccccgaacggggttcttaacggttagtttaaccttacggtacgggtaccgaaaccggtaacccggaccctaaaggtaaccgtcggaaaaccttccgaccgtaggtaccggtaccggtacggacgggggaaactaaaccgggg

SEQ ID NO: 438071 - DNA, 609 bp, Homo sapiens
  misc_feature: GZ8MTXP02FQTAG.21.23.C01.1.454.CMB.2.raw
  modified_base (295)..(295): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggagcttagtcagccgtgggggtccctgagactctcctgtgcagcctcgtggattcaccttcagtagctacgtggatgccacgtcggtccncaagctaccgaggggacggctggtgtgggtctcgacgtataagagtgagtgggagtacgactacgaagcttacggccggtactccggtagacggggcgtacttcacctatcctacgagaacgacaacgcaaagaaccacgctacgtatacacgaacaaagtcgaaacgtagtactagggaagacggtaccggagacgacgtacgtggttaagtacgttaacgtggtacgtacgaaacggacccccaaggtaaccgtacggaaactaaccgacctaggtacggaacggtttaccgacggggaaccgaaaccgggg

SEQ ID NO: 438072 - DNA, 711 bp, Homo sapiens
  misc_feature: GZ8MTXP02I3PZ4.21.23.C01.1.454.CMB.2.raw
  modified_base (168)..(168): a, c, t, g, unknown or other
  modified_base (244)..(244): a, c, t, g, unknown or other
  modified_base (463)..(463): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttcctgttgctattttaaaggngtccagtgtgaggtgcagctggtggaggtccggggaggcttagtcagccgtgggggtccctgagactctctgtgcngcctctggtattccaccttcagtagctactggatgcacgtcggtccgccaagcctccgaggggaacggcgtgggtgtgggtctcgacgttattaatgtgagtggggatagacacgaagcgtacgccggacgtccggtagaacggggcccgtattaccgacctatcccgtaccgagaacgaccgaaaaccgacccgaaagaaccaccgctacggttaacncttacggaaacctaaatacggaaactcggttacgtaggacggaacggtaccccggaaggggacccgaaacggggtccgtttaagggttaggtttaactttaacccggttagggttacccgggaaccgaaaacccgggggttacccccaaaggggtaaaacccgttcggggaaaaccttaaccggaaccccgttaacggtacggggtacccggtacgggttaacgggggaaccgtaaaaacccgggggg

SEQ ID NO: 438073 - DNA, 749 bp, Homo sapiens
  misc_feature: GZ8MTXP02IUTPE.21.23.C01.1.454.CMB.2.raw
  modified_base (636)..(636): a, c, t, g, unknown or other
tcagtcgtcgctcgcacgaccggtgctcgatttagtacacgtgattagggattgggggccccagccctgggattcccagctgtttctgcttgctgatcaggactgcacacagagaactcaccatggagtttgggctgagctgggttttccttgttgctattttaaaaggtgtccagtgtgaggtgcagctggtggaggtccgggggaggcttagttcaggccgtgggggtccctgagactctctgtgcagcctcgtggacttcaccttcgagtagctacgtggatgcacgtcgggtccaccaacgcctccggaggggaagggctgggtgtgggtctctacgttattaatgtgtagtggggagtacgacacgaacgaccgtacggaccggtaaccgtccggggtacgggaaaacgggggtcccccgtaaacgtttaccccgaaacccgtacgttacccgtacccgaaaaggaaaccgaaacccgaaaaacccgggaaccctaaaaacgggaaaacccaccggttaccgttaaggttacctaccgtaggaaacctaaaaagttacggaaaaccttaggtaccgtaggaaacgggacgaccggaacggacgtacgggtcttagtacgttaattaccggnggtacgacccgtaaaccggaacccccgaaggtaaacccgtacggtaaaaccgtaacgacccggtaaagttcggggtaaccggttcgggaacgggggaaaccgaaaacccgggg

SEQ ID NO: 438074 - DNA, 626 bp, Homo sapiens
  misc_feature: GZ8MTXP02GY25E.21.23.C01.1.454.CMB.2.raw
  modified_base (249)..(249): a, c, t, g, unknown or other
  modified_base (273)..(273): a, c, t, g, unknown or other
  modified_base (278)..(278): a, c, t, g, unknown or other
  modified_base (300)..(300): a, c, t, g, unknown or other
  modified_base (538)..(538): a, c, t, g, unknown or other
tcagtcgtcgctcgcacgaccggtgctcgatttagtacacgtgattagggattgggggcccccagccctgggattcccagctgtttctgcttgctgatcaggactgcacacagagaactcaccatggagtttgggctgagctgggttttccttgttgcttattttaaaaggtgtccagtgtgaggtgcagctggtggaggtccgggggaggcttagttcagccgtgggggtccctgagactctcctgtncagcctctggtacttccacccttnagtanctacgtggatgcacgtcggccncaagctcgaggggagggctgggtgtggtctcgacgttattaatgtgagtgggatacgacacgaagctacggccgtactcgggtaggaacggggtcctattccgactactccaccgaagaacgaaccaaaccggacctaaaagaccaccggcttagtaactctagaactaaaacgtcggaaactaggtctagggacgaccggaccggacgggacacgggtcttagggtactagttacgnggtacgaccggtaaaccggccccaagggaacctagggaaacctaacggcctaaggtcgggaccgtacggaggggacctaaaaccgggg

SEQ ID NO: 438075 - DNA, 509 bp, Homo sapiens
  misc_feature: GZ8MTXP01AT3D2.25.70.G04.1.454.CMB.2.raw
  modified_base (199)..(199): a, c, t, g, unknown or other
  modified_base (389)..(389): a, c, t, g, unknown or other
  modified_base (403)..(403): a, c, t, g, unknown or other
  modified_base (413)..(413): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcagtcaggacattaccaattattagcctggtatcaacacaaacaggaaagtccctaaagctcctgatctatctgcatccacttgcagtcacggggtccatctcgcttcagcgcagtgatctgggacagatttcagtctcacatcaccggctgcagctgacagtctnctaacttattactntacaaaactntaccacaagttcgaaccccgttacgttagttttcggccgacgggggaccttacgacggttcggaaccttacgaaacggacttggaggtcttggccc

SEQ ID NO: 438076 - DNA, 538 bp, Homo sapiens
  misc_feature: GZ8MTXP01CBDLD.25.70.G04.1.454.CMB.2.raw
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcagtcaggacattaccaattattagcctggtatcaacacaaaccagggaaagtccctaaagctcctgatctattctgcatccaccttgcagtcacggggtcccatctcgcttcagcggcagtggatcgtgggacagtatttcagtctcaccatcaccggctgcacgctgacgtatcttgactaactttattaatactactaaaactactacactagtcgccccgttaacttaggttttcggccgtaacggggaccacggacgttacgggtaaccctacgaaacggtaaccgtgttacgggtcgttcggtaacccg

SEQ ID NO: 438077 - DNA, 514 bp, Homo sapiens
  misc_feature: GZ8MTXP01B0004.25.70.G04.1.454.CMB.2.raw
  modified_base (200)..(200): a, c, t, g, unknown or other
  modified_base (431)..(431): a, c, t, g, unknown or other
  modified_base (498)..(498): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcaccatcacttgccgggcagtcaggacattaccaattattagcctggtatcaacacaaacaggaaactccaaagctcctgatctattctgcatccacttgcagtcgacgggtccatctcgctcagcggcagtgatcgtgggactagtatttcagtctcaccatccaccggcctgcacgcctagacgtagtcttagtacctaactttattactatactaaaactntcacacgtcgcccgtacttagtttcgcgtacggggaccacgttgttacgtaacctagaaacggtacnggttcgtcgttgaacc

SEQ ID NO: 438078 - DNA, 533 bp, Homo sapiens
  misc_feature: GZ8MTXP01BKUNJ.25.70.G04.1.454.CMB.2.raw
  modified_base (200)..(200): a, c, t, g, unknown or other
  modified_base (225)..(225): a, c, t, g, unknown or other
  modified_base (416)..(416): a, c, t, g, unknown or other
  modified_base (426)..(426): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacattaccaattattagcctggtatcaacacaaaccaggaaactccctaaagctacctgatctattctgcatccacttgcagtcacggggtcccatctcgcttcagcgcagtggatcgtgggacagtatttcagtctcaccatccaccggctgcagcctagacgatcttgactaacttatactntaacaaactntacactagtcgaacccgtacttacgtttcggaccgaacggggaccaacgttcggttacggaacccgttacgaaaacggtaaccgtggttcgggtaacttcgaacccg

SEQ ID NO: 438079 - DNA, 509 bp, Homo sapiens
  misc_feature: GZ8MTXP01CRWD9.25.70.G04.1.454.CMB.2.raw
  modified_base (225)..(225): a, c, t, g, unknown or other
  modified_base (437)..(437): a, c, t, g, unknown or other
  modified_base (444)..(444): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggnagtcaggacattaccaattattagcctggtatcaacacaaaccaggaaagtccctaagctcctgatctattctgcatccacttgcagtcacggggtcccatctcgcttcagcggcagtggatcgtaggggacagtatttcagtctcaccatcaccggctcgcagcctgacgagtcttgctaacttatactatacaaaactatcactacgtcncccgtanagtttcggaccgacggggaccttacgcgttcggaacctacgaaaggactggttagcgttcgaacc

SEQ ID NO: 438080 - DNA, 440 bp, Homo sapiens
  misc_feature: GZ8MTXP01B76S1.25.70.G04.1.454.CMB.2.raw
  modified_base (315)..(315): a, c, t, g, unknown or other
  modified_base (320)..(320): a, c, t, g, unknown or other
  modified_base (358)..(358): a, c, t, g, unknown or other
  modified_base (404)..(404): a, c, t, g, unknown or other
  modified_base (429)..(429): a, c, t, g, unknown or other
  modified_base (431)..(431): a, c, t, g, unknown or other
  modified_base (433)..(440): a, c, t, g, unknown or other
tcagactgtacagtcacgaccggtgctcgatttagtgtagtgtgaagggaaaggggctggtgtgggtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcaagaggaggcatagcagcagctggctttgactgctggggccagggaccctggtcaccgtctcctcagcctccaccaagggccccatccggtccttcccccnggccncccctgcctcccaggacgccaccctcgagacgcccacngccggccctggggcctgccctggtccaaaggctactcccatgtacngtctgagcgggctgggcaaggccanangnnnnnnnn

SEQ ID NO: 438081 - DNA, 525 bp, Homo sapiens
  misc_feature: GZ8MTXP01DMLPN.25.70.G04.1.454.CMB.2.raw
  modified_base (200)..(200): a, c, t, g, unknown or other
  modified_base (413)..(413): a, c, t, g, unknown or other
  modified_base (424)..(424): a, c, t, g, unknown or other
  modified_base (474)..(474): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcgagtcaggacattaccaattattagcctggtatcaaacacaaaccaggaaagtccctaaagctcctgatctattctgcatccacttgcagtcacggggtcccatctcgcttcagcggcagtggatctgggacagatttcagtctcaccatcaccgctgcagctgacgatcttgactaacttattactntactaaaactntacactagtcgccccgtacttacggttttcggaccgtaaggggaccacgngttacggaaccttaacgaaacggtaaccgtggttacggcgttcggtaaccc

SEQ ID NO: 438082 - DNA, 510 bp, Homo sapiens
  misc_feature: GZ8MTXP01AC4JA.25.70.G04.1.454.CMB.2.raw
  modified_base (200)..(200): a, c, t, g, unknown or other
  modified_base (330)..(330): a, c, t, g, unknown or other
  modified_base (410)..(410): a, c, t, g, unknown or other
  modified_base (420)..(420): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggcagtcaggacattaccaattattagcctggtatcaacacaaaccaggaaagtccctaaagctcctgatctattctgcatccacttgcagtcaggggtcccatctcncttcagcgcagtggatctgggacagatttcagtctcaccatcaccggctgcagctgacgatcttgactaacttattactntacaaaactntacacacgtcgccccgtaattacggttttcggaccgtacggggaccacgcgttacggaaccttacgaaaggtactaggttgcgttgaacc

SEQ ID NO: 438083 - DNA, 540 bp, Homo sapiens
  misc_feature: GZ8MTXP01ANFD0.25.70.G04.1.454.CMB.2.raw
  modified_base (200)..(200): a, c, t, g, unknown or other
  modified_base (225)..(225): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacattaccaattattagcctggtatcaacacaaaccaggaaagtccctaaagctctgatctattctgcatccaccttgcagtcacggggtcccagtctcgcttcagcggcagtggatcgtggggacagtatttcagtctcaccatcaccggctgcagcctgacgatcttgctaacttattactgtacaaaactatacactacgtcgtccccgtaacgttacggttttcggacccgtaacgggggaacccttacgacggttacggaacccttacgaaacgggtaacctggttacggcgttcggaacccg

SEQ ID NO: 438084 - DNA, 588 bp, Homo sapiens
  misc_feature: GZ8MTXP01DV2RO.25.70.G04.1.454.CMB.2.raw
  modified_base (202)..(202): a, c, t, g, unknown or other
  modified_base (226)..(226): a, c, t, g, unknown or other
  modified_base (359)..(359): a, c, t, g, unknown or other
  modified_base (369)..(369): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtcctcccttccttcctgtctgcatctggtgganacagatcacatcacttggccgggnagtcaggactattaacaattattagcctaggtactacaaacaacaaaccgaaggaaactccctaagctcctagactctattctgctactcctacttgctagtcgtaccgggtcctatctcgcttacagccggnaggtgatcgnggggactagtattcagtctcaccactaccgaccggtcctcggcacgcctacgacgtacgttcttacgtacctaaactttacttacgtactaactaaaactactacacgtacgtccgtaaccgtacttacggtttcggaaccgtaacggggaaccttaacgttacgttacgggtaacctaaacggtaaacggtaccgtaggttacgtcgttcgtaacccg

SEQ ID NO: 438085 - DNA, 539 bp, Homo sapiens
  misc_feature: GZ8MTXP01CIQD6.25.70.G04.1.454.CMB.2.raw
  modified_base (201)..(201): a, c, t, g, unknown or other
  modified_base (226)..(226): a, c, t, g, unknown or other
  modified_base (341)..(341): a, c, t, g, unknown or other
  modified_base (435)..(435): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcaccatcacttggccggnagtcagacattaccaattattagcctggtatcaaacacaaacaggaaagtccctaagctcctgatctattctgcatccacttgcagtcacggggtcccatctcgcttcagtcggntagtggatcgagggacagtacttcgagtctacaccatccaccggctcgcacgcctgacgtatcttagacctaacttatactataactaaaactntacactacgtcgtccccttaagttcggtttcggccgtaacggggaccacgcggttacgaaccgttaacgaaacggtaccgttggttacgggtcttcggaacccg

SEQ ID NO: 438086 - DNA, 539 bp, Homo sapiens
  misc_feature: GZ8MTXP01AN8BQ.25.70.G04.1.454.CMB.2.raw
  modified_base (198)..(198): a, c, t, g, unknown or other
  modified_base (223)..(223): a, c, t, g, unknown or other
  modified_base (367)..(367): a, c, t, g, unknown or other
  modified_base (402)..(402): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttctgtctgcatctgtggganacagagtcaccatcacttgccgggnagtcaggacattaccaattattagcctggtatcaacacaaaccaggaaagtccctaaagctcctgatctattctgcatccacttgcagtcacggggtccatctcgcttcagcgcagtgggatcgtgggacagtatttcagttcncaccatccaccggcctgcacgctcgacgagtcttntctaacttacttactatacaaaactaacttacacaacgtcgtcccgtacgttacgtttacggttccgacgggtaaccgacgacggttacggtaaccgtacgaaacggaaccgtacggttaggtcgttcggtaacccg

SEQ ID NO: 438087 - DNA, 686 bp, Homo sapiens
  misc_feature: GZ8MTXP01D1EIU.25.70.G04.1.454.CMB.2.raw
  modified_base (201)..(201): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagttctccttccttcctgtctgcatctgtggganacagagtcaccatcacgttggccgggcgagtcaaggactattacaattattagctgtatacaaacaacaaaacgaggaaactccctaaagcctacctgactactaattctagcactcctacttgcagtccgacggggtcccatccgtcgcttacacggtcggactagtcggatccgtaggggactagtactttcgacttactactaccacgttaccgaacccgggtccttacggcctacgaccccgtaggtaacccgtactttaccggtttacgtaacctttaaaccgttttaaattaaccccgttaagttaaacctaaaaaaaccttacctaccgtaaactaaacccggtccgttaaccccggttaaacctttacgggttttaccggaacccggtaaaccgggggaaacccttaaccgacggttaccggaaccgttaaaccggaaaacggtaaaccgttagggacggttcggttccgtaacccg

SEQ ID NO: 438088 - DNA, 602 bp, Homo sapiens
  misc_feature: GZ8MTXP01CKJ6B.25.70.G04.1.454.CMB.2.raw
  modified_base (203)..(203): a, c, t, g, unknown or other
  modified_base (230)..(230): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtctccttccttcctgtctgcatcgtggtggganacagagtcaccatcacgttggccgggnagtcaggactattaaccaattattagcctaggtaactacaaacaactaaaaccgaagggaaactcccctaaagcctacctagaacttcttaattctagtacctactccctacttgacacgtcgaccggggtcccagttccgtacgtcttacgacggcgactaggtggactcgtaggggactagtacttacagtctcaccactaccgaccggcctcgacgacgtcctacgacgtacgtcttacgtactaacttattactactaactaaactactacactacgtccgtaacccgtaagttcggtttacggccgtaacgggaccacgttcggttacgtaacctacgaaacgtacgtgttacggtcttcgtaaccc

SEQ ID NO: 438089 - DNA, 589 bp, Homo sapiens
  misc_feature: GZ8MTXP01ANTIU.25.70.G04.1.454.CMB.2.raw
  modified_base (203)..(203): a, c, t, g, unknown or other
  modified_base (232)..(232): a, c, t, g, unknown or other
  modified_base (571)..(571): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtcctccttccttcctgtctgcatcgtggtgganacagacgtacaccatcacgttggccgggnagtcaaggactacttacaattattagcctaggtactacaacaacgaaaccaggaaactccaaagctcctgattctatctagcactccacttgactagtcgacgggtcccatccgtcgtctacgacggcgcgtaaggtgtactcggtagggactaggtactttcacgttcctacaccacttacccgccgtctcgacgacgccgtagacgtacttcgttcgtaaccttaacttattacctagtaaacctaaacgtctaccaagtcgtaccgtaacccgttaagttcggttccggacgacgggtaaccacggttacgttaccggtaaccctagaaacggtcnggttacggcttcggaacc

SEQ ID NO: 438090 - DNA, 563 bp, Homo sapiens
  misc_feature: GZ8MTXP01ALX3X.25.70.G04.1.454.CMB.2.raw
  modified_base (200)..(200): a, c, t, g, unknown or other
  modified_base (223)..(223): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagatcacatcacttgccgggnagtcaggacattaccaattattagcctggtatacaaacacaaaccagggaaactccctaagcctcctgatctattctgcatccaccttgcagttcacggggtcccatcctcgcttcgagcggcaggtggactcgtggggactaggtactttcagtcttacacctaactccgaccgggccttcgggccaacggtccctcgggtactacgtcttacggactaaactttacttactataactaaactatacactacgtcgtccccgtaacttcggttttcggaccgtacggggaccacgcgttacggaacccgtagaacggactacggttggccttgaacccg

SEQ ID NO: 438091 - DNA, 565 bp, Homo sapiens
  misc_feature: GZ8MTXP01ASTPX.25.70.G04.1.454.CMB.2.raw
  modified_base (199)..(199): a, c, t, g, unknown or other
  modified_base (224)..(224): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgaccagtctccttccttctgtctgcatctggtggganacagagtcaccatcacttgccgggnagtcaaggacattaccaattattagcctagtactacaaacacaaaccaggaaacgtccctaaagcctacctagactctaattctgctactccacttgctagtccgacgggtccccagtcctacgcttacaggcgcagtggactcgagggactagtattcagtctacacactccgaccggctacgcacgccctagacgtacttcgttacgacttaacttattactactaactaaactctaccaactacgtccgtaacccgtagttacggtttacggaccggtacgggaccttacgacggttaccgaaccgtacgaaacggacgtggttacggcttcgaaccc

SEQ ID NO: 438092 - DNA, 658 bp, Homo sapiens
  misc_feature: GZ8MTXP01E2S5M.25.70.G04.1.454.CMB.2.raw
  modified_base (206)..(206): a, c, t, g, unknown or other
  modified_base (232)..(232): a, c, t, g, unknown or other
  modified_base (313)..(313): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggcctcccaggtaccagctgtgacatccagatcgacccagtcctccttccttcctgtctgcatcgtggtaggganacagactccaccatcacgtggccggnagtcaaggactattactaattattagcctagtactacaaacaacaaaccgaggaaactccctaagcctctagatcttatcngcctactccacttcgctacgtccgaccgggtcccatccgtacgcttacgagcggactaggtcggtacgtcggtaggaactagttacttacgactcctaccaaccgacgttaccccggaaccggtccgtcgtacgaccgtacccgtacgaaccgttactttacgtacggttaaaccttaaaccgtttaacttaaccgtaacgttaaaccttaaaaaccgttcctaaccgtaaccgtacgtacccggttaaccccgttaacgttacgggtttaccggaccggtaaaccgggaccacgttacggttaccgaacctacgtaaacgtacgtcggcgtaacgcgtaacccg

SEQ ID NO: 438093 - DNA, 579 bp, Homo sapiens
  misc_feature: GZ8MTXP01EJT1P.25.70.G04.1.454.CMB.2.raw
  modified_base (226)..(226): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctccaggtaccagctgtgacatccagatcgaccagtctccttccttcctgtctgcatctggtggagacagagtcacatcacgtgcggcgtacnggtacagtacattactatctagtatactaacgtactaaccaacgaaacacctaacgacgtacctacgtactctactactctactactctactgtcccctacgtcacggtccgtacgtaacgttccgtcgttccgtacgtccgtcgacgtcggtacgtacgtcggtacgtacggtagtactagtactactactctacaccgaccgtccgacgacacggctacgtcgtacgtacgtacgtacttacgtactaacttactaactaactaactaactacttactacgttaccgtacgtacgttacgttcgttacggtaacgtacgtaacgacgtacgttacgtaacgttaacgtaag

SEQ ID NO: 438094 - DNA, 524 bp, Homo sapiens
  misc_feature: GZ8MTXP01B1KV9.25.70.G04.1.454.CMB.2.raw
  modified_base (197)..(197): a, c, t, g, unknown or other
  modified_base (221)..(221): a, c, t, g, unknown or other
  modified_base (410)..(410): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttcctctgtctgcatctgtggganacagagtcaccatcacttgccggnagtcaggacattaccaattattagcctggtatcaaacacaaaccaggaaagtccctaagctacctgatctattctgcatccaccttgcagtcacggggtcccatctcgcttcagcgcagtggatcgtgggactagatttcagtctcaccatcaccggcctgcacgcctagacgatcttgactaactttnttaacctgtaactaaaactactacaactacgtccaacccgttattacgttttcggaccgtaggggacccacgttaggttacggaacctagaacggactggcgtccgttgaaccc

SEQ ID NO: 438095 - DNA, 560 bp, Homo sapiens
  misc_feature: GZ8MTXP01DM53Y.25.70.G04.1.454.CMB.2.raw
  modified_base (145)..(145): a, c, t, g, unknown or other
  modified_base (203)..(203): a, c, t, g, unknown or other
  modified_base (208)..(208): a, c, t, g, unknown or other
  modified_base (214)..(214): a, c, t, g, unknown or other
  modified_base (229)..(229): a, c, t, g, unknown or other
  modified_base (287)..(287): a, c, t, g, unknown or other
  modified_base (300)..(300): a, c, t, g, unknown or other
  modified_base (304)..(304): a, c, t, g, unknown or other
  modified_base (340)..(340): a, c, t, g, unknown or other
  modified_base (357)..(357): a, c, t, g, unknown or other
  modified_base (382)..(382): a, c, t, g, unknown or other
  modified_base (464)..(464): a, c, t, g, unknown or other
  modified_base (486)..(486): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctccaggtaccngctgtgacatccagatcgacccagttcctcctttccttcctgtctgcatcgtgtgganacagntcaccntcacgttcggccggnagtcagactattactattattagcctgtatacaaacacaaacgaggtaaactcctaanctactgtactctntctncctactcctattcgctagtccgtacggtcccatccncgtctaccgagccggtnaggtgactcgtggactatctttacncgtactcgaccacgttacccgaccggtctagcacgcctagacgtacttctacgtacttaactttatactagtaaccaaactntacactacggtcctaaccgttnttacggttccggacgaacgggtaccaggttcgttacgtaacctaaagtaacgacttcggacgtcttccggaacc

SEQ ID NO: 438096 - DNA, 597 bp, Homo sapiens
  misc_feature: GZ8MTXP01EK2HI.25.70.G04.1.454.CMB.2.raw
  modified_base (152)..(152): a, c, t, g, unknown or other
  modified_base (169)..(169): a, c, t, g, unknown or other
  modified_base (206)..(206): a, c, t, g, unknown or other
  modified_base (233)..(233): a, c, t, g, unknown or other
  modified_base (316)..(316): a, c, t, g, unknown or other
  modified_base (417)..(417): a, c, t, g, unknown or other
  modified_base (430)..(430): a, c, t, g, unknown or other
  modified_base (434)..(434): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtnacatccagatcgacccngttcctccttccttctgtctgctatcgtggtaggganacagactcaccatcacgttcggccggnagtcaggactattaacctaattattacgcctagtactacaaacaacgaaacgaggtaaactccaagcctctagatctatcganctaactccattcgactacgtcggaccggtccctagtccgtcgtccttacgacgcggtactagggtcgtacgtcgtagggacttacgtattcgactctcacntacccgacgtccncgcncgtctacgactgtcgtactacttaacttactactaactaaactaacgtactaccgtacgtccgtaccgtaaccgttacgttacgggtacgaccggtacgtaaccgttacgttacggttaaccgaacgtaaggtaacgtcgcggttactaacgttaaccgaacg

SEQ ID NO: 438097 - DNA, 672 bp, Homo sapiens
  misc_feature: GZ8MTXP01BQK9C.25.70.G04.1.454.CMB.2.raw
  modified_base (200)..(200): a, c, t, g, unknown or other
  modified_base (224)..(224): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccggnagtcaggacattacaattattagctgtatcaaacacaaaccaggtaaactcctaaagctacctagtactctattctgcactccacttgcagtcgacgggtccatctcgcttcagcgcaggtgactcgtggggactagtactttacgacgttcctacaaccctaacgttcccgaaaccccggggtccttacgggacctaacggtcccgttacggtaaccggtaacggtttcctttacgggtaacccttaaaaccgttttaactttaaacccgttaacgttaacccttaaaaaaccttaccttaccggtaaaccctaaccgggttacccgtaacccccggttaacgttacgggttttaccggaccggttaacgggggaacccttaacgttacgggttacgtaacccgtaacggtaaacggtacccgtagggttacgccgttcggtaaccc

SEQ ID NO: 438098 - DNA, 526 bp, Homo sapiens
  misc_feature: GZ8MTXP02JLENV.25.70.G04.1.454.CMB.2.raw
  modified_base (200)..(200): a, c, t, g, unknown or other
  modified_base (377)..(377): a, c, t, g, unknown or other
  modified_base (433)..(433): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttggccgggcagtcaggacattaccaattattagcctggtatcaacaacaaaccagggaaacgtccctaagcctcctgatctattctgcatccacttgcagtcacggggtcccatctcgcttcagcggcaggtggatcgtggggacaggtatttcgagtcncacatcaccggcctgcagcctagacgatcttgactaattattactgtacaaaactntacacagtacgtacccgtatacggtttcgaccgacggggtaccacgtacggtacggaacctaacgaaacggtaaccgtgtacggtcacggacc

SEQ ID NO: 438099 - DNA, 503 bp, Homo sapiens
  misc_feature: GZ8MTXP02J11XU.25.70.G04.1.454.CMB.2.raw
  modified_base (389)..(389): a, c, t, g, unknown or other
  modified_base (393)..(393): a, c, t, g, unknown or other
tcagactgtacagtcacgaccggtgctcgatttagtgtagtgtgaagggaaggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcagtcaggacataccaatattagcctggtatcaacacaaaccagggaaagtccctaaagctcctgatctatctgcatccacttgcagtcaggggtcccatctcgcttcagcggcagtggatctgggacagatttcagtctcacatcaccggcctgcagcctgacgancttncactatatagtacaaactactacacacgtacgtacccgtactacgttacggtaccgacggaccgacgacgtacggaaccgtacgaaacgaacgtacgtcggtacgtcgcg

SEQ ID NO: 438100 - DNA, 529 bp, Homo sapiens
  misc_feature: GZ8MTXP02I1L5O.25.70.G04.1.454.CMB.2.raw
  modified_base (360)..(360): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctgtgggagacagagtcaccatcacttgccgggcagtcaggacattaccaattatttagcctggtatcaacacaaaccagggaaagtccctaagctcctgatctattctgcatcaccttgcagtcaggggtcccatctcgcttcagcggcagtgatctggggacagattnagtctcaccatcaccggctgcagcctgacgatcttgctaattatactgtacaaaactatcaacagtcgacccgttactaacgtttttcgggaccaagggggacccaacacgggttacgggaacccttacgaaaacggtaaaaccgtggtacgggtcttacggtaacccg

SEQ ID NO: 438101 - DNA, 523 bp, Homo sapiens
  misc_feature: GZ8MTXP02G79MV.25.70.G04.1.454.CMB.2.raw
  modified_base (199)..(199): a, c, t, g, unknown or other
  modified_base (223)..(223): a, c, t, g, unknown or other
  modified_base (414)..(414): a, c, t, g, unknown or other
  modified_base (424)..(424): a, c, t, g, unknown or other
  modified_base (434)..(434): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccggngagtcaggacattaccaattattagcctggtatcaacacaaaccaggaaagtccctaaagctcctgatctattctgcatccacttgcagtcacggggtcccatctcgcttcagcggtcagtggatcgtgggacagtatttcagtctcacatcaccggctgcagcctgacgatcttgactaacttatacctntacaaaactntacacagtcnccccgtatacgttttcggaccgaacgggggccaacgtacgttacgggaaccttacgaaaacgggtacctaggtacggtactcggaaccc

SEQ ID NO: 438102 - DNA, 544 bp, Homo sapiens
  misc_feature: GZ8MTXP02JWGUJ.25.70.G04.1.454.CMB.2.raw
  modified_base (202)..(202): a, c, t, g, unknown or other
  modified_base (227)..(227): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtcctccttccttcctgtctgcatctggtggganacagagtcacatcacttggccgggnagtcaggacattaccaattattagcctggtatcaacacaaaccaggaaactcctaagctcctgatctattctgcactccacttgcagtcacggggtcccatctcgcttcagcggcaggtggatcgtgggacaggtatttcagtctcaccatcaccgctgcacgcctgacgatctgactaacttattactgtaacaaaacttatacactacgtccgtaccccgttactacggttttcggaccggtaacggggacccacgtacggtacggtaacccgtaacgtaaaacggtaacgtggtacggtacgtacggtaacccg

SEQ ID NO: 438103 - DNA, 530 bp, Homo sapiens
  misc_feature: GZ8MTXP02GGGZA.25.70.G04.1.454.CMB.2.raw
  modified_base (200)..(200): a, c, t, g, unknown or other
  modified_base (225)..(225): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacattaccaattattagcctggtatcaacacaaaccagggaaagtccctaagctcctgatctattctgcatccaccttgcagtcacggggtcccatctcgcttcagcggcagtggatcgtgggacagattcagtctcacatcaccggcctgcagcctgacgatcttgctaaacttattacctagtacaaaactactacaactagtcgaccccgtactaggttttcggaccgacgggggaccacgacgttacgggaaccttacgaaaacggtaaaccgtggtacggcgttacgaacccg

SEQ ID NO: 438104 - DNA, 512 bp, Homo sapiens
  misc_feature: GZ8MTXP02HHO2Q.25.70.G04.1.454.CMB.2.raw
  modified_base (201)..(201): a, c, t, g, unknown or other
  modified_base (261)..(261): a, c, t, g, unknown or other
  modified_base (400)..(400): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtctccttccttcctgtctgcatctgtggganacagatcaccatcacttggccgggcagtcaggacataccaattattagcctggtatcaanacaaacaggaaagtacccaagctcctgatctattctgcatccactgcagtcaccggggtcccatctcgcttcacgcggcagtggatcgtgggacagagtttcagtctcacatcaccgcctgcacgcctgacgatcgttnctacttattactatacaaactatacactacgtcgtacccgtactacggtttcgaccgacggggaccacgtagtacggaacctacgaaacggtacgtacgtcggactcgaccg

SEQ ID NO: 438105 - DNA, 438 bp, Homo sapiens
  misc_feature: GZ8MTXP02HZN9I.25.70.G04.1.454.CMB.2.raw
  modified_base (316)..(316): a, c, t, g, unknown or other
  modified_base (330)..(330): a, c, t, g, unknown or other
  modified_base (405)..(405): a, c, t, g, unknown or other
  modified_base (413)..(413): a, c, t, g, unknown or other
  modified_base (429)..(438): a, c, t, g, unknown or other
tcagactgtacagtcacgaccggtgctcgatttagtgtagtgtgaagggaaaggggctggtgtgggtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcaagaggaggcatagcagcagctggctttgactgctggggccaggggaaccctggtcaccgtctcctcagccctcaccaaggcccatcggtctcccctggccnccctgctccaggcnccacctccgagacgcccacgacgccggccctggggccttgccgtggtcaaacggcttacttccactgtacagtcngagcgggntggcaaggcgcatagnnnnnnnnnn

SEQ ID NO: 438106 - DNA, 508 bp, Homo sapiens
  misc_feature: GZ8MTXP02HTAG4.25.70.G04.1.454.CMB.2.raw
  modified_base (200)..(200): a, c, t, g, unknown or other
  modified_base (225)..(225): a, c, t, g, unknown or other
  modified_base (339)..(339): a, c, t, g, unknown or other
  modified_base (354)..(354): a, c, t, g, unknown or other
tcagactgtacagtcacgaccggtgctcgatttagtgtagtgtgaagggaaaggtggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggngagtcaggacattaccaattatttagcctggtatcaacacaaaccagggaaagtccctaaagctcctgatctattctgcatccacttgcagtccaggggtcccatctcgcttcngcggcagtggatcgngggtacagattcagtctcaccatcaccggctgcagcctgacgatcttgctaaacttatactatacaaaactatacacagtcaccccggttacaacgttttggacctacgggggaccacgacgttcggaacctacgaaacggaactgtcggctcg

SEQ ID NO: 438107 - DNA, 543 bp, Homo sapiens
  misc_feature: GZ8MTXP02JVVAV.25.70.G04.1.454.CMB.2.raw
  modified_base (200)..(200): a, c, t, g, unknown or other
  modified_base (225)..(225): a, c, t, g, unknown or other
  modified_base (247)..(247): a, c, t, g, unknown or other
  modified_base (394)..(394): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacatacaattattanctgtatcaacacaaacaggaaactcctaagctcctgatctattctgcatccacttgcagtcacggggtccatctcgcttcagcgcagtgatcgtgggacagtatttcgagtctacaccatcaccggctgcagcctagacgattcgtnactaattactactacgtaactaaaactacttacactacgtccgtaccccgttacgttacggttttacggaccggaacggggtaacccacgtaacgggttacgaacccgttaacgaaaacggtaccgtaggttacggcgttacggaaccc

SEQ ID NO: 438108 - DNA, 562 bp, Homo sapiens
  misc_feature: GZ8MTXP02IIU80.25.70.G04.1.454.CMB.2.raw
  modified_base (200)..(200): a, c, t, g, unknown or other
  modified_base (225)..(225): a, c, t, g, unknown or other
  modified_base (291)..(291): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacataccaattattagctgtatcaacacaaacaggaaatcctaagctctgatctattcngcatccaccttgcagtcgacggggtcccatctcgcttcagcggcagtggatcgtgggacagtatttcagtctacaccactcaccggcctagcacgcctagacgtatctttagacctaacttattaactagtaactaaaacttacttacactacgtaccgtaccccgtaaacgttcggttttacggacccggaacggggtaaccctaacgtaacggtacggtaaaccgttacgaaaacggtacctaagggttcgggactttacggaaccccg

SEQ ID NO: 438109 - DNA, 497 bp, Homo sapiens
  misc_feature: GZ8MTXP02G8MSW.25.70.G04.1.454.CMB.2.raw
  modified_base (200)..(200): a, c, t, g, unknown or other
  modified_base (223)..(223): a, c, t, g, unknown or other
  modified_base (310)..(310): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcacatcacttgccggnagtcagacatacattattagctgatcaacacaaacaggaaatccaagctctgatctatctgcatccactgcagtcacgggtccatcncgcttcagcgcaggtggatcgtagggactagtattcagtctacacatcaccgctgcacgctgacgatctagctaattatactagtactaaaactctacgactacgtccgtacccgtagtacgtttcggaccgacgggaccacgagttacggaacctacgaaaacggtactagtcggtctacggaacc

SEQ ID NO: 438110 - DNA, 552 bp, Homo sapiens
  misc_feature: GZ8MTXP02IPI9I.25.70.G04.1.454.CMB.2.raw
  modified_base (200)..(200): a, c, t, g, unknown or other
  modified_base (224)..(224): a, c, t, g, unknown or other
  modified_base (402)..(402): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgcgggnagtcaggacattaccaattattagcctggtatcaaacacaaaccagggaaatccctaaagctcctgatctattctgcatccaccttgcagtcacggggtcccatcctcgacttcagcggcagtggatcgtgggactagatttcagtctcacatcaccgctgcagcctgacgatcgttnactaacttattacgtactaacaaaacttactacaactacgtccgtacccgtaacgttacggttttacggaccgacggggtaacccaacgtaacggtacggaaccccgttaagaaaaccggtacgtacgtacgggacctttacggaacccg

SEQ ID NO: 438111 - DNA, 567 bp, Homo sapiens
  misc_feature: GZ8MTXP02GEYB7.25.70.G04.1.454.CMB.2.raw
  modified_base (201)..(201): a, c, t, g, unknown or other
  modified_base (226)..(226): a, c, t, g, unknown or other
  modified_base (353)..(353): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcaccatcacttggccggnagtcaggacattaccaattattagcctggtatacaacaacaaaccaaggaaactccctaagctcctgatctattctgctactcctacttgctacggtcgaccggggtcccatctcgcttcgagcggnagtgatcgtgggactagtattcagtcacacactccgacccggtctgccgacgtccgtagaccgtattcttagaccttaactttattacgtataacctaaacttactacaactacgtaccgtaccccgttaagtcggtttaccggaccgtaacggggaccacggtacggtaccggaaccgtaacgaaaacggtactggcggtacgtacgaacccg

SEQ ID NO: 438112 - DNA, 556 bp, Homo sapiens
  misc_feature: GZ8MTXP02IA5MY.25.70.G04.1.454.CMB.2.raw
  modified_base (200)..(200): a, c, t, g, unknown or other
  modified_base (335)..(335): a, c, t, g, unknown or other
  modified_base (348)..(348): a, c, t, g, unknown or other
  modified_base (359)..(359): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtcctccttccttctgtctgcatctgtggganacagagtcacatcacttgccgggcgagtcgaggacattaacaattattagcctggtactacaacacaaaccgaggaaacgtcctaaagctctgactctattctgcactccactgactagtcgaccgggtccatcncgtcttcacgcgngacgtgatcgngggacagtacttcagtctacacactcaccggtcctgccgacgcctagcgtattcttacgacttaacttattactactaactaaaactattaccacgtacgtcgtaccccgttaacgttcggtttaccgaccggaacggggaaccacgtacggtaccggaaccgtacgaaaacggtacgtcggtacggtctacgaccg

SEQ ID NO: 438113 - DNA, 537 bp, Homo sapiens
  misc_feature: GZ8MTXP02GUDDL.25.70.G04.1.454.CMB.2.raw
  modified_base (199)..(199): a, c, t, g, unknown or other
  modified_base (224)..(224): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttcttcctgtctgcatctggtgganacagagtcaccatcacttgccgggnagtcaggacataccaattattagctggtatcaacacaaacaggaaagtaccaagctcctgatctattctgctatccaccttgcagtcacggggtcccatctcgcttcagcggcagtaggactcgtgggacagtatttcagtctcaccatccaccggctcgacacgcctagacgtatctgactaactttatactactaactaaaacctattacgaactaacgtcgtacccgtacgttaacggttttcggaccgtacgggggaccaacgtacggtacggaacctacgaaaacggactaggtcggcttacggaccc

SEQ ID NO: 438114 - DNA, 528 bp, Homo sapiens
  misc_feature: GZ8MTXP02GDTOJ.25.70.G04.1.454.CMB.2.raw
  modified_base (202)..(202): a, c, t, g, unknown or other
  modified_base (227)..(227): a, c, t, g, unknown or other
  modified_base (362)..(362): a, c, t, g, unknown or other
  modified_base (387)..(387): a, c, t, g, unknown or other
  modified_base (403)..(403): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtctccttccttcctgtctgcatctggtggganacagagtcaccatcacttggccggnagtcagacattaccaattattagcctggtatcaacacaaaccaggaaagtccctaaagctctgatctattctgcatccacttgcagtcacggggtccatctcgcttcagcgcaagtgatcgtgggacagtatttnagtctacaccatcaccggctgcacncctagacatcgtttanactaacttactactataactaaactactacgtactacgtaccgtaccgttacgttacggttacggacggtacggtacctacgacggtaacgaacgtaacgaaacggtacgtcgacgtcgacgtac

SEQ ID NO: 438115 - DNA, 560 bp, Homo sapiens
  misc_feature: GZ8MTXP02IU3EZ.25.70.G04.1.454.CMB.2.raw
  modified_base (200)..(200): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaaccatcacttggccgggcgagtcaggacattaccaattattagctggtatcaacacaaaccaggaaacgtcctaagctcctgatctattctgcactccaccttgcagtcacggggtcccatctcgcttcagcggcagtgatcgtgggacagtatttcagtctacacactcgacccgtctcgcacgccgtagacgtatcgttgactaactttactaacgtcgtaactaaaactactacctaactacgtaccgtacccgtaacgtacggttttcggacccgtaacggggacccaacgtacggtacggaaccgtaacggaaacggtaaacgtaggtacggacgttacgaacccg

SEQ ID NO: 438116 - DNA, 534 bp, Homo sapiens
  misc_feature: GZ8MTXP02FKC18.25.70.G04.1.454.CMB.2.raw
  modified_base (197)..(197): a, c, t, g, unknown or other
  modified_base (297)..(297): a, c, t, g, unknown or other
  modified_base (378)..(378): a, c, t, g, unknown or other
  modified_base (386)..(386): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatgacccagtctccttcctctgtctgcatctgtgganacagagtcaccatcacttgccgggcagtcaggacattaccaattattagctgtatacaacacaaacgaggaaagtccctaaagctcctagattctattcngcactcctacttgctagtcgacgggtccatctcgtcttcagcgcaggtgactcgtaggacagtattcagtctacactaccncgaccgcncgcacgctagactatctactactaacttatactataactaaactacactacgtacgtaccgtaccgttacgttacggttacggacggtaacggaccgtacgacgtacgtaacgtaacgaaacggtacgtacggtacgtacgtacgacg

SEQ ID NO: 438117 - DNA, 580 bp, Homo sapiens
  misc_feature: GZ8MTXP02FW673.25.70.G04.1.454.CMB.2.raw
  modified_base (202)..(202): a, c, t, g, unknown or other
  modified_base (433)..(433): a, c, t, g, unknown or other
tcagactgtacagtcacgaccggtgctcgatttagtgtagtgtgaaggggaaagggggcagcagtctctctcagtcaggacacagcatggacatgagggtccctgctcagctcctgggactcctgctgctctggctcccaggtaccagctgtgacatccagatgacccagtctccttccttcctgtctgcatctggtggganacagagtcaccatcacgttggccggcgagtcaggacattacaattattagctggtatacaacacaaaccgaggaaacgtccaaagctctagatctattctcgactactcctaaccttcgctagtccgaccggggtccctactctcgtcttcgagcggctaggtgacgtcgtgggacagtacttcacgtctacactacaccgaccgctcgccgacgctacgacgtatcgttnacttaacttacttaactataactaaactataccaacgtacgtaccgtacccgttacttacggtttcggaaaccgtacgggggtacccaacgtaacggtacgtaaaccgtaacgtaaaacggggtactagggtcggcttacggaaccg

SEQ ID NO: 438118 - DNA, 743 bp, Homo sapiens
  misc_feature: GZ8MTXP02GO4ZU.25.70.G04.1.454.CMB.2.raw
  modified_base (201)..(201): a, c, t, g, unknown or other
  modified_base (229)..(229): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtctccttccttcctgtctgcatctggtgganacagagtcaccatcacgttcggccgggngagtcgaaggacattacctaattattagcctggtaactacaacaacaaaccgaggaaactcctaagctctgactactattctgtccactcctaccttcgactacgttacgacccggggtccctacgtccgtccgtccgtttacgacgggccggtctacgggttacgggacttaccggtacgggggtaacctaggttaacccgtttacgtacggttccctaccgtaccctaacgtttaccccggaacccggtccgttacggaccgtaaaccggtcccgttaacgggtaacccgttaacgtttcgtttacggaaacccgtttaaacctttaactttaacccggtttaaacgttaaacctaaaaacggtttactaaccctaacggtaacgttacccggttaaccccgtaacggtttaggttttaccggaccggttaacggggaacccgtaacgtaaggtaccggttaaaccgtaacgggtaaaacggtaacgttggtacggtaacgtcggtaacccg

SEQ ID NO: 438119 - DNA, 520 bp, Homo sapiens
  misc_feature: GZ8MTXP02GYIU1.25.70.G04.1.454.CMB.2.raw
  modified_base (199)..(199): a, c, t, g, unknown or other
  modified_base (224)..(224): a, c, t, g, unknown or other
tcagactgtacagtcacgaccggtgctcgatttagtgtagtgtgaagggaaaggggcagcagtctctctcagtcaggacacagcatggacatgagggtccctgctcagctcctgggactcctgctgctctggctcccaggtaccagctgtgacatccagatgacccagtctccttccttcctgtctgcatctgtggganacagagtcaccatcacttgccgggnagtcaggacattaccaattattagcctggtatcaacacaaaccaggaaagtcctaagctcctgatctatctgcatccacttgcagtcacggggtcccatctcgcttcagcgcagtgatcgtggacagattcagtctcacatcaccgctgcagcctgacgtatcttgactaacttattactgtacaaactattacaactagtcgtacccgtactagttttcggacctacggggaccacgtacggttcggaacccgttacgaaaacggtaccgtaggttacggccgttacggtaaccc

SEQ ID NO: 438120 - DNA, 597 bp, Homo sapiens
  misc_feature: GZ8MTXP02I3M3N.25.70.G04.1.454.CMB.2.raw
  modified_base (201)..(201): a, c, t, g, unknown or other
  modified_base (226)..(226): a, c, t, g, unknown or other
  modified_base (350)..(350): a, c, t, g, unknown or other
tcagactgtacagtcacgaccggtgctcgatttagtgtagtgtgaagggaaagggggcagcagtctctctcagtcaggacacagcatggacatgagggtccctgctcagctcctgggactcctgctgctctggctcccaggtaccagctgtgacatccagatcgacccagtctccttccttctgtctgcatctggtggganacagagtcacatcacttcggccggnagtcaggacattacctaattattagcctggtatcaacacaaacgaggaaactcctaagctcctgatctattctgctactcctacttgacagtcgacgggtcccagtctcgtcttcgagtcgganacggtgtactcgtagggacagtactttcgatcctacactaacgtacgacccggcttcggacacgtccgtacgggtaaccctttacgttaccgttacgtaaccttaacgtttaacttaacgttaacgttaaacttaaactactaccgtaacgtacgtaccgtaccgttacgttacggttaccggacgtaacggtacgtaacgtacgtacgtaacgtaacgtaacgtcgtacgtacgtacgtacgtacg

SEQ ID NO: 438121 - DNA, 583 bp, Homo sapiens
  misc_feature: GZ8MTXP02JD9O0.25.70.G04.1.454.CMB.2.raw
  modified_base (76)..(76): a, c, t, g, unknown or other
  modified_base (180)..(180): a, c, t, g, unknown or other
  modified_base (197)..(197): a, c, t, g, unknown or other
  modified_base (239)..(239): a, c, t, g, unknown or other
  modified_base (294)..(294): a, c, t, g, unknown or other
  modified_base (405)..(405): a, c, t, g, unknown or other
tcagactgtacagtcacgaccggtgctcgatttagtgtagtgtgaagggaaagggggcagcagtctctctcagtcnggacacagcatggacatgagggtccctgctcagctcctgggactcctgctgctctggctcccaggtaccagctgtgacatccagatgacccagtctccttctcngtctgcatctgtggganacagagtcaccatcacgttgcggcagtcaggacattactaancttagctaggatacaacacaaacgaggaaactccaagctcctagctactacttcncgtcactacctacgttacgacacgtcggtaccccgggtacctctcgttccgtactcggcgcgacggttaggcgtacgtcggtacggtaacgtcttacgtattaccgtcctnaccactacgacccggtaccgtcgtcgacgccgtacgtacgtacgtacttacgtactaacttacttaacttacgtactaaactactactactacgtacgtaccgtacgttacggttacgtacggacggacgacgtacgtacgtaacgtacgtaacggtacgtacggtcgacgtacgtcg

SEQ ID NO: 438122 - DNA, 401 bp, Homo sapiens
  misc_feature: GZ8MTXP01EQ4YD.13.78.H01.1.454.CMB.2.raw
  modified_base (304)..(304): a, c, t, g, unknown or other
  modified_base (317)..(317): a, c, t, g, unknown or other
  modified_base (394)..(394): a, c, t, g, unknown or other
  modified_base (396)..(396): a, c, t, g, unknown or other
  modified_base (398)..(401): a, c, t, g, unknown or other
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggcacttttgatatctggggccaaagggtcgatggtcatcgtctcttcagcctccaccaaggcccatcggtctcccctggcncctgctccaggancactcgagagcacagcgcctgggctcgcctgtcaaggctaacttctaagtacgtgactgagcgggctggcaaggcananannnn

SEQ ID NO: 438123 - DNA, 407 bp, Homo sapiens
  misc_feature: GZ8MTXP01AK0O5.13.78.H01.1.454.CMB.2.raw
  modified_base (395)..(395): a, c, t, g, unknown or other
  modified_base (401)..(407): a, c, t, g, unknown or other
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctcacaagggcccatcggtctcccctggcgccctgctccaggagcacctccgagagcacagcgccctgggctcgcctggtcaaggactaacttcctgtacgtgactgagcgggctggcaaggcncatagnnnnnnn

SEQ ID NO: 438124 - DNA, 583 bp, Homo sapiens
  misc_feature: GZ8MTXP02GC8UH.13.78.H01.1.454.CMB.2.raw
  modified_base (202)..(202): a, c, t, g, unknown or other
  modified_base (540)..(540): a, c, t, g, unknown or other
  modified_base (542)..(544): a, c, t, g, unknown or other
  modified_base (547)..(549): a, c, t, g, unknown or other
  modified_base (551)..(583): a, c, t, g, unknown or other
tcagtcacgtactacacgaccggtgctcgatttagtgtgagtagtttgggtttggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagntcgagatgtgtcagtcggcgggctacttttgatacgtcgtggggaccaagggtcgagtggtctagttcgtcttctcacgccctccaccgaacgggcccagtccggtcccctcccccgtgccccgtccctacgcctccggacggacgtcccctaccccgtccggaaagacgccaaccggtacggccccggtcccggtggggtcctccccggtacccggttcggtaacgaaaacgggttacccttaaccgtttccgaacgggttccgtacggtaacgttacgggacgggggccggggtacgtccggggaaaccgtaaacggggcggtaaacctaagggtngnnncgnnngnnnnnnnnnnnnnnnnnnnnnnnnnnnnnnnnn

SEQ ID NO: 438125 - DNA, 483 bp, Homo sapiens
  misc_feature: GZ8MTXP02JB9JJ.13.78.H01.1.454.CMB.2.raw
  modified_base (325)..(325): a, c, t, g, unknown or other
  modified_base (443)..(443): a, c, t, g, unknown or other
  modified_base (455)..(455): a, c, t, g, unknown or other
  modified_base (461)..(483): a, c, t, g, unknown or other
tcagtcacgtactacacgaccggtgctcgatttagtgtgagtagtttgggtttggggaaatctatcatagtgggaccacctactacagccccgtccctcaatagtcgcgtcaccatgtcagtggacgagcccaagaacccagttctccctgagcctgacctctgtgaccgccgcggactcggccctatacttctgtgcgagagatcgagtagtgtgtcatcggcggggctacttttagattatcgtggggaccgaagggtcgagtggtcagtcgtctcttcacgcctccaccgaacggcccagtccggtccctccccgtggcccnccctgcctccgaggacgccaccgtccggaagacgaccacgacgcccgggccccgtggggcctccggccgtggtacaacggtacttacgttccgtagtcgcgacgtgacgggcggtcgnggacgtaacggngcaaannnnnnnnnnnnnnnnnnnnnnn

SEQ ID NO: 438126 - DNA, 603 bp, Homo sapiens
  misc_feature: GZ8MTXP01EXH6U.44.36.D03.1.454.CMB.2.raw
  modified_base (222)..(222): a, c, t, g, unknown or other
  modified_base (229)..(229): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcgtgtaggtatttacaagtgtcagagtgaagtgcagtgtggagtcggggagactgtcgngcgtggnggtcgtgagactctctgtgtcgctcgtgtatcacatcagtgacactatagtggacgtcggtccgcgacggcgtaccggaggggaagggggcggtgggaggtggtcgtcggaccggaccgaaagtaaaaacgtaaagtacgaccgaacgtacttaactacaacgagacgtacgcgtcgtcgtagtagaacgacgacgactactaccctactacaagagagtagtactacaacgtaactactattagtatcgtagtacgtaatacgtaactaaaccgtaaacgaaacggaaacggaacgacggtacgttaagtagttaagttagttgttgtttaagttagtttaagttagtacgttacgtaacgttaacgtaaccg

SEQ ID NO: 438127 - DNA, 576 bp, Homo sapiens
  misc_feature: GZ8MTXP01DUK2L.44.36.D03.1.454.CMB.2.raw
  modified_base (309)..(309): a, c, t, g, unknown or other
  modified_base (311)..(311): a, c, t, g, unknown or other
  modified_base (314)..(314): a, c, t, g, unknown or other
  modified_base (316)..(316): a, c, t, g, unknown or other
  modified_base (333)..(333): a, c, t, g, unknown or other
  modified_base (349)..(349): a, c, t, g, unknown or other
tcagacagtatatacacgaccggtgctcgatttagctgcgtcacgatctctcttggggagctctgagagcggagccccagccccagaattccccaggtgttttcattttggtgatcagcactgaacacagaggactcaccatggagttcgggctgagcgtggtttctgtaggtatttacaagtgtccagagtgaagtgcagtgtggagtcggggagactgtcagctggaggtccgtgagactctcctgtgtcgctctggatcaccatcagtgacactatatgactggtcgccagctccaggaagggggngnggngngcgtgcgacgaagaaanaagtagacaatacttntacacagagtacgcgcgtcgtgtagaagacgagtactacctacctactacaagaagatacgtactactaacgtaactactattagtacttacgtacgtacgtaacgtacgtaacgtaaaccgtaaacgaaaaccggaaacggaacggaacggtacgttagttagttaagtttagtttgtttagtttgtttagtttaagttagtacgttacgtaacgttaacgtaacg

SEQ ID NO: 438128 - DNA, 638 bp, Homo sapiens
  misc_feature: GZ8MTXP01EU2OO.44.36.D03.1.454.CMB.2.raw
  modified_base (382)..(382): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggatcaccatcagtgaccactatatggactgggtccgcaggctccgaggggaagggggctgggagtggcttgggccgcaagtaaaaacaaagttgcccaaagtcctttaancaacgagacgtaccgccgcgtctagtagaaacgccgaagtacttcccaaccctctacgaaagagatacgtaaccttaacgaaacggtaaccttactaatttacgtaactttccgtacggaacgtaaactacgtaaaccctaaaaccgtaacggaaaaacccgggaaggaaacccgacgggggtacttaagttagttaatttagtttggttgtttaagttagtttaatacgtacgttaaggtaaccgttcggtcccg

SEQ ID NO: 438129 - DNA, 598 bp, Homo sapiens
  misc_feature: GZ8MTXP01EAOWQ.44.36.D03.1.454.CMB.2.raw
  modified_base (341)..(341): a, c, t, g, unknown or other
  modified_base (373)..(373): a, c, t, g, unknown or other
  modified_base (426)..(426): a, c, t, g, unknown or other
  modified_base (465)..(465): a, c, t, g, unknown or other
  modified_base (479)..(479): a, c, t, g, unknown or other
  modified_base (519)..(519): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgctctggatcacatcagtgaccactatatggactgggtccgccaggctccgagggaagggctggagtggcttggccgnaaggtaaaaacaagttgcccaaagtctttaancaacgagacgtaccgcgcgtctagagaaacgccaagtacttacccaacccctntaacaaagagtaatacgtaaccttacgaaaggtaacttnaatttgaatttcgngaacgaaatcgtaaaccttaaaccgtaaggaaaaaccggnggaaccgacggggtacttaagttaggttaatttagttggttagttgttacgtttaatatcgaaggtaacttggtaaccc

SEQ ID NO: 438130 - DNA, 570 bp, Homo sapiens
  misc_feature: GZ8MTXP01AGGFO.44.36.D03.1.454.CMB.2.raw
  modified_base (312)..(312): a, c, t, g, unknown or other
  modified_base (361)..(361): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtcggccccgaggggagacggccaggattaccgtggtggggcgacgcggttggaaggtaaagtgtacagtgacagcagacgcaggccacgaccctgtgctggtcatctatatgatgcgggccgcctnagtgactccctgcgcgcttcccgccggctccaactcgtaacgggaaccncggcccacccgtgacccatcgagcgaggggtcgacggggccggggatcggacggccgtaacttacttacgtcgtcagcgtggtagggggacaggtagtagtgatcacgtcccggtgtacgttcggcgggacggaaccaaggccgtacgacccgtcggtgggttcgcgaccccgaaggcctccgcccccgtggcctccgttcgttccccg

SEQ ID NO: 438131 - DNA, 577 bp, Homo sapiens
  misc_feature: GZ8MTXP01B0NRD.44.36.D03.1.454.CMB.2.raw
  modified_base (216)..(216): a, c, t, g, unknown or other
  modified_base (299)..(299): a, c, t, g, unknown or other
  modified_base (361)..(361): a, c, t, g, unknown or other
  modified_base (411)..(411): a, c, t, g, unknown or other
  modified_base (420)..(420): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgtagtatttacaagtgtcagagtgaagtgcagttggtggagtccggggganacttggtccagcctgggagggtccctgagactctcctgtgtcgcctctggatcacatcagtgaccatatatggactgggtccncaggctcgaggggagggctgggagtggcttggccgaacaaagtaaaacagtcacaagtcttncagagacgtaccgccgtcgtctagtagaaacgccagtacttcccaccctntacaaaganatacgaacttacaaaggtaactactattagtattctagtacgtaactacgtaactaaaccgtaaacgaaaccggaaacggaacggacgggacgttagtagttagttagtttgttggtttgtttagtttaagttatacgttacgtaacgttcgtaacg

SEQ ID NO: 438132 - DNA, 524 bp, Homo sapiens
  misc_feature: GZ8MTXP01D70DY.44.36.D03.1.454.CMB.2.raw
  modified_base (271)..(271): a, c, t, g, unknown or other
  modified_base (309)..(309): a, c, t, g, unknown or other
  modified_base (490)..(490): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttgggtacaggcggggggggtccctgagactctcctgtgcagcctcnggattcatcttcagtgactatgccatgaactgggtccncaggctcgaggggagggctggagtgggtttcatatgttaatattgctggagataccacctactacgcagactctgtaggaacgggccattaccacctaattcccagggacaatgacccaaaggaactcactgtatctaggaaatgaacagcctgagaagacgaggacacgggctgttcttnttctgtcgaagagagttcgggccttaacgttggg

SEQ ID NO: 438133 - DNA, 572 bp, Homo sapiens
  misc_feature: GZ8MTXP01DRCAL.44.36.D03.1.454.CMB.2.raw
  modified_base (372)..(372): a, c, t, g, unknown or other
  modified_base (376)..(376): a, c, t, g, unknown or other
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaaggtgtcagagtgaagtgcagttggtggagtccgggggagacttggtccagcctggagggtccctgagactctcctgtgtcgcctctggatcaccatcagtgaccactatatggactgggtccgccaggctccgagggaaggggctgggagtggcttggccgacaagtaaaaaacaagttgccaaagctttaanacanagacgacgcgtcgtctgtagaacgcatactccacctcacgaaganatcgtacttacaaacgtaactctaattgtattcgagacgtaatacgtaaacctaaaccgaagaaaaccggaaggaacgacggtacttagttagttatttagttgttgtttaagttagtttaactagtacgttacggtaacttcggtaaccg

SEQ ID NO: 438134 - DNA, 668 bp, Homo sapiens
  misc_feature: GZ8MTXP01DJ4YF.44.36.D03.1.454.CMB.2.raw
  modified_base (223)..(223): a, c, t, g, unknown or other
  modified_base (307)..(307): a, c, t, g, unknown or other
  modified_base (401)..(401): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcagttggtggaggtccggggganacttggtccagcctggagggtccctgagactctcctgtgtcgctctggatcaccatcagtgaccactatatggactgggtcccnccaggctccgagggggaagggggctggggagtggcttggggcccgtaccaaaggttaaaaaaacaaggtttcgaccctaaagtacctttttaanacaaacgtaaggtacgtaccggcccggtcgttcgtaggtagaaacgccaagtacttacccacccctctaacgaaagagtatacgtaacttacgaaacggtaacttctaattacgatttcgaggacgtaaatcgtaaaccttaaaccgtaaacggaaaaaccggaacgggaaccgacggggtacttaaagtttacgttaagtttagtttcggtttgtttaaggtttacgttttaatacgtacggttaacgggtaacttcggtaacccg

SEQ ID NO: 438135 - DNA, 598 bp, Homo sapiens
  misc_feature: GZ8MTXP01BBP24.44.36.D03.1.454.CMB.2.raw
  modified_base (378)..(378): a, c, t, g, unknown or other
  modified_base (397)..(397): a, c, t, g, unknown or other
  modified_base (425)..(425): a, c, t, g, unknown or other
  modified_base (457)..(457): a, c, t, g, unknown or other
  modified_base (469)..(469): a, c, t, g, unknown or other
  modified_base (507)..(507): a, c, t, g, unknown or other
  modified_base (521)..(521): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggatcacatcagtgaccactatatggactggtccgccaggctccgaggggaagggctgggagtggcttggccgacaaggtaaaaacaagttgacccaagtctttaancaacagagtacgcgcgtcngtagaaagccagtacttccaaccccttntacaaagagatcgtaacttacaaaggtacttntattgtattcgngacgtaaatcgtaaacctaaaccgaacggaaaaccggnggaacgaacggggnttaagttaggttaatttagtttggtttacgtttaagttagtttaacttagtcgaacgggtaaccttcgggtaacccg

SEQ ID NO: 438136 - DNA, 543 bp, Homo sapiens
  misc_feature: GZ8MTXP01BDBCB.44.36.D03.1.454.CMB.2.raw
  modified_base (307)..(307): a, c, t, g, unknown or other
  modified_base (371)..(371): a, c, t, g, unknown or other
  modified_base (410)..(410): a, c, t, g, unknown or other
  modified_base (468)..(468): a, c, t, g, unknown or other
  modified_base (478)..(478): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggtccnccaggctccgagggagggctggagtggcttggccgcaagtaaaaacaagttgccaagctttaancacagagtacgcgcgtctgtgaaagcagattcaaccctntcaagagatgaacttcaaaggaactcaatttgattctgacgaaatcgaacttaaaccngaaaacccgnggaacacggggcagttagtattagttgttagtttgtcgtttaatatcgaggtaacttgtaacccg

SEQ ID NO: 438137 - DNA, 622 bp, Homo sapiens
  misc_feature: GZ8MTXP01CSJ9D.44.36.D03.1.454.CMB.2.raw
  modified_base (229)..(229): a, c, t, g, unknown or other
  modified_base (237)..(237): a, c, t, g, unknown or other
  modified_base (259)..(259): a, c, t, g, unknown or other
  modified_base (265)..(266): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagtttcggggctgagcgtggtttcgtgtaggtatttcaagtgtcagatgaagtgcagtggtggagtcggggagactgtccagctggnggtcctgngatctctgtgtcggctctggtntcacannagtacgacactatagtgacgtcggtccgcgacggcgtacgagggaggggcggtggaggtggtcgtcggacgaccgaacgtaaaacgtaaagtacgtacgaacgtacttaactacacgaacgacgtacgcgtacgtacgtagtagaacgacgacgtacttacctacctactacgaacgagatagtactacgtaacggtaactactattagtacttacgtacgtacgtaacgtacgtaaactaaaccgtaaacggaaaacggaaacggaacggaacggtacgttagttagttaagtttagtttgttaggtttaagttagtttaagttacgttacgttaacggtaacgttaacgtaacg

SEQ ID NO: 438138 - DNA, 496 bp, Homo sapiens
  misc_feature: GZ8MTXP01BTMF8.44.36.D03.1.454.CMB.2.raw
  modified_base (479)..(479): a, c, t, g, unknown or other
tcagacagtatatacacgaccggtgctcgatttagctgcgtcacgatctctcttgggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattgggagatataacctgtctcctggtatcaaacaacatccaggcaaagccccaaactcatacttttgagtcagtgagcgcgtcaggtgtttctaatcgcttctctggctcaagtctggccacacgcctcctgtcgatctctcgggctccggctgagacgaggctggactattactgcgctcatttacaactcttgagtcttgggtgttcgggcggagggactcacccgttgaccgtctaggtcngcccaggcttcgccccg

SEQ ID NO: 438139 - DNA, 558 bp, Homo sapiens
  misc_feature: GZ8MTXP01B1OCW.44.36.D03.1.454.CMB.2.raw
  modified_base (204)..(204): a, c, t, g, unknown or other
  modified_base (343)..(343): a, c, t, g, unknown or other
  modified_base (369)..(369): a, c, t, g, unknown or other
  modified_base (451)..(451): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggacccccggnagagggtcatcatctcttgttctggaagcagttccaacatcggccctaattctgtatattggtaccagcaacgtcccaggaaccgcccccaaactcctcatctatagactaatcagccgccctgagggtccctgaccgnttcctcctggctccgaagtctggccnctcagccctccctggccatcacgtcgggccccgtcgaggacgagtgattacgtactgcgcagtcgttgggggattcggaccnccgtgaggcttggctcggttcgggcggagggaccaaacgtcgaccggtcaggtcgcgccccgagccgtcgccccctcggttccaccttcgttccggttcccgtcccc

SEQ ID NO: 438140 - DNA, 593 bp, Homo sapiens
  misc_feature: GZ8MTXP01D5HN9.44.36.D03.1.454.CMB.2.raw
  modified_base (306)..(306): a, c, t, g, unknown or other
  modified_base (341)..(341): a, c, t, g, unknown or other
  modified_base (389)..(389): a, c, t, g, unknown or other
  modified_base (420)..(420): a, c, t, g, unknown or other
  modified_base (438)..(438): a, c, t, g, unknown or other
  modified_base (504)..(504): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgctctggatcacatcagtgaccactatatggactgggtccnccaggctcgagggagggctggagtggctggccganaaggtaaaaacaagtgaccaaagtctttaagcaacagacgtacgccgngtctgtagaaagccagtacttccaccccttntacaaagagatgacttanaaaggtaactctaattgaatttccagacgtaaattcgaaaccttaaaccgtaggaaaaaaccccgngggaaccgaacggggtcaaagttgttaatttagttggttacggtttgttagttttaactagttcgaagggtaaacttcgggtaaccccg

SEQ ID NO: 438141 - DNA, 658 bp, Homo sapiens
  misc_feature: GZ8MTXP01EXY2B.44.36.D03.1.454.CMB.2.raw
  modified_base (224)..(224): a, c, t, g, unknown or other
  modified_base (398)..(398): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccggggganacttggtccagcctgggagggtccctgagactctcctgtgtcgctctggatcacatcagtgaccactatatggactgggtccgccaggcctaccggagggggaaggggctggggagtggcgttggacccgacaaaggtaaaaaaacaaggtttcgaccctaaagtccttttaanacaacgagacggtaccgccgtcgtactagtaagaaacgccgaagtaccttacccaacccctactaacaaaggagtatacgtaaccttaacgaaacgggtaacttactaatttacgtatttcgtaggtaacgtaaaacgttacgtaaacccttaaaccgaaacggaaaaacccggaaggaaccgacgggtacttaagttagttaatttagttggttgtttaagttagtttaacgtagtacgaaggtaacgttcggtaaccg

SEQ ID NO: 438142 - DNA, 446 bp, Homo sapiens
  misc_feature: GZ8MTXP01BU1V3.44.36.D03.1.454.CMB.2.raw
  modified_base (440)..(446): a, c, t, g, unknown or other
tcagacagtatatacacgaccggtgctcgatttagctgcgtcacgatctctcttggggcttgatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcaatctagtgggggccgtggcaccctggtcactgtctcctcagcttccaccaagggcccatcggtctcccctggcgccctgctccaggagcacctcgtcgggggcacgagcggccctggggctgcctgggtcaatgactacttcctatatactgtctgagcgggctggcaaggcgcataggnnnnnnn

SEQ ID NO: 438143 - DNA, 602 bp, Homo sapiens
  misc_feature: GZ8MTXP01BKU58.44.36.D03.1.454.CMB.2.raw
  modified_base (225)..(225): a, c, t, g, unknown or other
  modified_base (270)..(270): a, c, t, g, unknown or other
  modified_base (278)..(278): a, c, t, g, unknown or other
  modified_base (378)..(378): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccggggganacttggtccagcctggagggtccctgagactctcctgtgtcgctntgatcacntcagtgaccactatatggactggtcccgcgaggctccgaggggagggctggagtggcttggccgacaagtaaaaacaagttcgaccctaagtcctttaancaagagacgtaccgccgtcgtcgtgaacgaacgccagtacttacccaccctctacgaagagtatacgaacttacaaagtaactntattagtattcgtagacgtaaagtcgtaaacctaaaccgtaacgaaaaccggaacggaacgacgggtacttagttagttaatttagttggtttgttgtttacgtttaatacgtacgttaaggtaaccgttcggtaacccg

SEQ ID NO: 438144 - DNA, 572 bp, Homo sapiens
  misc_feature: GZ8MTXP01CQAI1.44.36.D03.1.454.CMB.2.raw
  modified_base (547)..(547): a, c, t, g, unknown or other
  modified_base (550)..(550): a, c, t, g, unknown or other
  modified_base (556)..(556): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccagggaaggccctggagtggcttgcacacatcttctcgaatgaacgaaaatcctacagtacatctctagaagagcagtttaaccatctaccaagacacctaccaaagcaggtgtctttagtatagaccaacatcggaccctgcggacaccgaggacacatattaactgtgacgaacgggtaaatggaacgggaaaagaaacagtcttgtttactagttattataagtcttaccatcgtaggacgtcgtaggggacaaacgggggaccctacgggtccaccggtcctcctcgacgtcctccaccgacgggcccagtcccggtccttccccgtggccgccctgccttcgaggaanccncgtcgnggggcaacgcggccgg

SEQ ID NO: 438145 - DNA, 571 bp, Homo sapiens
  misc_feature: GZ8MTXP01CJS55.44.36.D03.1.454.CMB.2.raw
  modified_base (301)..(301): a, c, t, g, unknown or other
  modified_base (338)..(338): a, c, t, g, unknown or other
  modified_base (364)..(364): a, c, t, g, unknown or other
  modified_base (371)..(371): a, c, t, g, unknown or other
  modified_base (380)..(380): a, c, t, g, unknown or other
  modified_base (384)..(384): a, c, t, g, unknown or other
  modified_base (398)..(398): a, c, t, g, unknown or other
  modified_base (408)..(408): a, c, t, g, unknown or other
  modified_base (415)..(415): a, c, t, g, unknown or other
  modified_base (423)..(423): a, c, t, g, unknown or other
  modified_base (433)..(433): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatcagtgaccactatatggactgggtccnccaggctccgaggggaagggctggagtggcttggccnaagtaaaacaagttcgccagctttancaacagngtacgccgngtcngtgaaagcccaagnttcacccttnacaaganatgactanaaagtaactntattggattcgagacgtaatcgaacctaaaccgaaggaaaacccgaggaccgacgggctaagttgttaatttagttgttaggtttgttagtttattacgtgaaggtaactggtacccaggtcggggaacccgtaaggg

SEQ ID NO: 438146 - DNA, 522 bp, Homo sapiens
  misc_feature: GZ8MTXP01ANN5L.44.36.D03.1.454.CMB.2.raw
  modified_base (245)..(245): a, c, t, g, unknown or other
  modified_base (430)..(430): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggganatataactgtctctgtatcaacacatccaggacaaacgccccaaactcattacttttgagtccagtgagcggccgtcaggttgtttactaatcgctttctcgtggcctccgaagtctggccacaccggccctccctgtcgactctcgtcgggcctccggcctggagacgaggctgggactattcngcgctctattacactctgatcgttggtgttcgggcggagggactcaccgttcgacccgtcgtggtcacggcccaggtccgttccgtcccccg

SEQ ID NO: 438147 - DNA, 617 bp, Homo sapiens
  misc_feature: GZ8MTXP01DXGQT.44.36.D03.1.454.CMB.2.raw
  modified_base (374)..(374): a, c, t, g, unknown or other
  modified_base (424)..(424): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggaggtccctgagactctcctgtgtcgcctctggattcaccatcagtgaccactatagtggactgggtccgccaggctccgaggggaaggggctgggagtggctgggccgacaaagtaaaaacaaggttcgaccagtctttaancaaacagaagtaccgccgcgtctgtagaaacgccagtacttccacccctntacaaagagattgacttacaaagtaacctactatttaggaatttcctaggaccgtaaatcgaaaccttaaacctaacgggaaaaaacccggtgggaaaccaccggggactaagttgttaaagtttattggttgtttgttagttttacttagtctaaggtaacttgtaccccgagttcgggggccctaacgggg

SEQ ID NO: 438148 - DNA, 572 bp, Homo sapiens
  misc_feature: GZ8MTXP01BPLJ7.44.36.D03.1.454.CMB.2.raw
  modified_base (308)..(308): a, c, t, g, unknown or other
  modified_base (344)..(344): a, c, t, g, unknown or other
  modified_base (370)..(370): a, c, t, g, unknown or other
  modified_base (413)..(413): a, c, t, g, unknown or other
  modified_base (421)..(421): a, c, t, g, unknown or other
  modified_base (443)..(443): a, c, t, g, unknown or other
  modified_base (454)..(454): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggatcaccatcagtgaccactatatggactgggtccnccaggctccgaggggagggctggagtggcttggccncaagtaaaacaagttgccaagctttncacagagtacgcgcgtctgtgaaagccagacttcaaccccttntacaaganatcgtacttacaaaggtaactntattgattcgngacgtaaatcgtaaacctaaaccgtaacggaaaaccggaagggaacgacggggacttagttagttaatttagttggttagtttgttagtttaatactgaacgggtaacttcgtaaccg

SEQ ID NO: 438149 - DNA, 605 bp, Homo sapiens
  misc_feature: GZ8MTXP01CM0U9.44.36.D03.1.454.CMB.2.raw
  modified_base (286)..(286): a, c, t, g, unknown or other
  modified_base (377)..(377): a, c, t, g, unknown or other
  modified_base (436)..(436): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggagtccgggggagacgttggtccagcctggagggtccctgagactctcctgtgtcgcctctggatcaccatcagtnaccactatatggactgggtccgccaggctccgaggggagggctgggagtggctggccgacaagtaaaaacaagttgacccaagtctttaancaacagacgtacgccgctctagtagaaacgccagacttccacccttctacaaaggtaanatacgtaacttacaaagtaactgtaattagaatttccgaggacgtaaatacgtaaacctaaaccgtaacggaaaaaccggtaagaaccgacgggtacttaagttagttatttagtttgttggtttaagttagttttaactagtacgttaacggtaacttcggtaacccg

SEQ ID NO: 438150 - DNA, 563 bp, Homo sapiens
  misc_feature: GZ8MTXP01BRBCA.44.36.D03.1.454.CMB.2.raw
  modified_base (319)..(319): a, c, t, g, unknown or other
  modified_base (347)..(347): a, c, t, g, unknown or other
  modified_base (406)..(406): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctcaaggacacctacaaaaggcaggtgtcttagtatgacaanatggacctgcgacacagcacatataacngtgacacgggtaatgacgggaaaagaaacagctgttctagtattataagtcttacatcnggacgtcgtgggacaaagggggccacggtccaccgtctccgtcagtccttccacccgaaacgggcccaacgtccggtcccttcccccgtggcccgtcccctcggccttccgacggaacgcccgaaccgttcggcgggggcctaaccgcggccccggg

SEQ ID NO: 438151 - DNA, 678 bp, Homo sapiens
  misc_feature: GZ8MTXP01C4ATZ.44.36.D03.1.454.CMB.2.raw
  modified_base (191)..(191): a, c, t, g, unknown or other
  modified_base (237)..(237): a, c, t, g, unknown or other
  modified_base (315)..(315): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctcgtgtctggtcncctggacagtcgtcaccatctcctgcactggagccagcggtaaatnttcttagtcttaacttgtctctggtatcaaacatcataccaaggtaaacaccccaaatcatcatctatgagacctaanaagacgccctgtagggtttacaatcgcttcactcgtacctccgaaacgtcccgggacaaaccgaccgggtccccttaccccgtaaacaacctaactccgtaccggtcgggtaccgtaccggacgggtacgtagggaacgggaacgtacgggtacgttaagttaaattttaaggtttagtttcggtttacgtacgttacgtaacgtacgttacggttaccgttaccgtactaactacttaacgttaacgttacggttacggttacgggttaacgggtaacgggtaacggttaacggttaccgttacccgtaaccgtacggtaaccgaaccgaacccgaacccgtaaccccgaaccccgtaaccg

SEQ ID NO: 438152 - DNA, 599 bp, Homo sapiens
  misc_feature: GZ8MTXP01AC0GR.44.36.D03.1.454.CMB.2.raw
  modified_base (377)..(377): a, c, t, g, unknown or other
  modified_base (421)..(421): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggtccgccaggctccgagggaaggggctgggagtggcttgggccgcaagtaaaaacaagttgacccaagctttaancacagagtacgcgcgtctgagaaacgccagtacttcccaccctntacaaagagtatagacttacaaaggtaactctattagatttcgtgacgtaaatcgtaaaccttaaaccgtacggaaaaacccggngggaaaccgacggggacttaagttagttaatttagttggttaggtttggtttagtttaacttagtacgttaagggtaaccgttcggtaacccg

SEQ ID NO: 438153 - DNA, 559 bp, Homo sapiens
  misc_feature: GZ8MTXP01BFMDV.44.36.D03.1.454.CMB.2.raw
  modified_base (323)..(323): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctaccaaaaggcaggtgtctttagtatgaccaanatggaccctgcggacaccaggcacatattaactgtgcgaacgggtaaatggacgggaaagaaacagctggtttctgtattataagtcttacctatctggacgtcgtggggacaaagggggccacgggtccaccgtctcctcacgcttccaccgaacgggcccagtccggtcttcccctcggccgcccgttcgccgttccacgggaacgcaaccgtcgtgggggcaacgcgcccggg

SEQ ID NO: 438154 - DNA, 588 bp, Homo sapiens
  misc_feature: GZ8MTXP01DZF7E.44.36.D03.1.454.CMB.2.raw
  modified_base (376)..(376): a, c, t, g, unknown or other
  modified_base (424)..(424): a, c, t, g, unknown or other
  modified_base (456)..(456): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggatcaccatcagtgaccactatatggactgggtccgccaggctccgaggggagggctggagtggcttggccgacaagtaaaaacaagttgcccaagtctttaancacagacgtacgccgcgtctgtagaaagccaagtacttcaaccccttntacaaagagatgactttacaaaggtaaccttntaattgattcgtgactaaatcgtaaacctaaccgaaggaaaacccgaaggaaccgacgggtcttaagttagttaatttagtttgttcggtttgttagtttaactagtacgaacggttaacttcggtaacccg

SEQ ID NO: 438155 - DNA, 558 bp, Homo sapiens
  misc_feature: GZ8MTXP01EW2OU.44.36.D03.1.454.CMB.2.raw
  modified_base (309)..(309): a, c, t, g, unknown or other
  modified_base (381)..(381): a, c, t, g, unknown or other
  modified_base (462)..(462): a, c, t, g, unknown or other
  modified_base (538)..(538): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgctctggatcaccatcagtcgaccactatatggactggggtccncaggctcgaggggaggggctgggagtggcttaggccgacaagtaaaaaacaagttcgacccaagtctttaancacagtacgtaccgcgcgtctgtagaaacgccagacttccaccctctacaagacgatgacttcaaaggactcattgattcngacgaatgtaactaaccgtagaaaacccgaaggacacggggcttagtgttaattagttgttgtttgttgtttaatntcgaggtaacttgtaacccg

SEQ ID NO: 438156 - DNA, 586 bp, Homo sapiens
  misc_feature: GZ8MTXP01A5NG3.44.36.D03.1.454.CMB.2.raw
  modified_base (383)..(383): a, c, t, g, unknown or other
  modified_base (460)..(460): a, c, t, g, unknown or other
  modified_base (473)..(473): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggtccgccaggctccgaggggaagggggctgggagtggcttgggccgacaaggtaaaaacaagttcgacccaagtctttaancaacgagacgtacgccgcgtctgtagaacgccagtacttccaccctctacaagagatacgtacttacaaagtaactntattagtattcgngacgtaatcgtaacctaaccgtaacgaaaaccggaaggaacgacgggacttagttagttaattagttgttgttgttagtttaatacgtacgttaaggtaacgttcggtaaccg

SEQ ID NO: 438157 - DNA, 557 bp, Homo sapiens
  misc_feature: GZ8MTXP01D6QGB.44.36.D03.1.454.CMB.2.raw
  modified_base (217)..(217): a, c, t, g, unknown or other
  modified_base (374)..(374): a, c, t, g, unknown or other
  modified_base (382)..(382): a, c, t, g, unknown or other
  modified_base (484)..(484): a, c, t, g, unknown or other
  modified_base (494)..(494): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtcccgccaggctccgaggggaaggggctgggagtggcttgggccgacaagtaaaaacaagttcgaccagtctttancaaacagngtacgccgcgtctgtagaaacgccagacttccaccctctacaagagatgacttacaaagaactcattgatttctagacgaatgaactaacgtaagaaaccgnggacacgggnaatgttattattgtgttgttgtttattagtcaaggtaactggtccagtcggggcctaacgggg

SEQ ID NO: 438158 - DNA, 637 bp, Homo sapiens
  misc_feature: GZ8MTXP01ET6G8.44.36.D03.1.454.CMB.2.raw
  modified_base (284)..(284): a, c, t, g, unknown or other
  modified_base (327)..(327): a, c, t, g, unknown or other
  modified_base (419)..(419): a, c, t, g, unknown or other
  modified_base (476)..(476): a, c, t, g, unknown or other
  modified_base (485)..(485): a, c, t, g, unknown or other
  modified_base (578)..(578): a, c, t, g, unknown or other
  modified_base (614)..(614): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttccttgttgttattttacaaggtgtccagagtgaagtgctaggttgggtggaggtccgggggagtacgttggtccagtccgtgggacgggtccctgagtactctcctgtgtccgcctntggatcaccatcagtcgaccactatagtggacttggggtcccnccgaggcctaccggaagggggaagggggtctggggagttggcgttgggcccgacaaaggtaaaaaacaagttcgaccctaaagtcttttaancaacgagagttacccgcgtcgtctagtagaaacgcccagtacttcccaaaccccttntaacaaganactacgtaacttacgaaacggtaacttctaagttgtacttcgagaacgtaaatacgtaaacctaaacgaacgaaaaccggaaggaacgacggnttaagttagttaatttgttgttgtttgttatttaangtacgagttaacgttcgtaaccg

SEQ ID NO: 438159 - DNA, 617 bp, Homo sapiens
  misc_feature: GZ8MTXP01AV2OD.44.36.D03.1.454.CMB.2.raw
  modified_base (306)..(306): a, c, t, g, unknown or other
  modified_base (373)..(373): a, c, t, g, unknown or other
  modified_base (516)..(516): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgctctggatcaccatcagtgaccactatatggactgggtccnccaggctccgaggggaaggggctgggagtggcttggccgcagtaaaacaagttgaccaagctttaancacagacgtacgccgcgtctgtagaaacgccagtacttccaccccttctacgaagagatacgaactttacgaaacgggtactctaattagaactttccgtagaccgtaaatcgtaaaccttaaaccgtacgggaaaaacccgngggaaccgacgggggtacttaagttaggttaactttagtttgggttcggtttaagtttacgttttaatacgttacgttaacgggttaacttcggtaacccg

SEQ ID NO: 438160 - DNA, 592 bp, Homo sapiens
  misc_feature: GZ8MTXP01A3ZWR.44.36.D03.1.454.CMB.2.raw
  modified_base (312)..(312): a, c, t, g, unknown or other
  modified_base (391)..(391): a, c, t, g, unknown or other
  modified_base (488)..(488): a, c, t, g, unknown or other
  modified_base (524)..(524): a, c, t, g, unknown or other
  modified_base (570)..(570): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacttggtccagccgtgggacgggtccctgagactctcctgtgtcgctctggatcaccatcagtgaccactatatggactggggtccnccagggctaccgagggggaagggctgggagtggcttgggccgacaaggtaaaaaacaaggttcgcccaaagtctttaancaacagacgtaccgccgcgtctgtagaaagcccaagtacttccaaccccttctacgaaagacgatcgaactttacaaaggtaactctattagattcngacgaaatcgaaacctaaccgtaacggaaaacccgnggaacgcggggacttagtagttattagttgttgtttgtagtttaanatcgaagtaacgttgtaacccg

SEQ ID NO: 438161 - DNA, 628 bp, Homo sapiens
  misc_feature: GZ8MTXP01D49YH.44.36.D03.1.454.CMB.2.raw
  modified_base (321)..(321): a, c, t, g, unknown or other
  modified_base (449)..(449): a, c, t, g, unknown or other
  modified_base (483)..(483): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgttgttattttacaaggtgtccagagtgaagtgcaggttggtgggaggtccgggggagtacgttggtccaggccgtgggacgggtccctgagactctcctgtcgtcgcctctggatcaccatcagtcgaccactatatggactgggtcccnccgaggctccggagggggaaggggctgggagtggcgttggccgacaaaggtaaaaacaagttcgacctaagtctttaagcgacagacgtaccgcgcgtctagtagaaagccaagtacttccacccctntacaaagacgtatcgaacttacgaaaggtaactntaattgaacttcgagacgtaaaatcgtaaaccttaaacccgtaaggaaaaaccccggtgggaaaccaccgggggtacttaagttaggttaatttgtttggttgttttcgtagttttaatagtacgaaggtaacttcgtaacccgg

SEQ ID NO: 438162 - DNA, 716 bp, Homo sapiens
  misc_feature: GZ8MTXP01BCQM7.44.36.D03.1.454.CMB.2.raw
tcagacagtatatacacgaccggtgctcgatttagctgcgtcacgatctctcttgggtcctgtcccaggtcaccttgaaggagtctggtcctgtgctggtgaaacccacagagaccctcacgctgacctgcaccatctctgggttctctctcaacgatattagaatgggtgtgagctggatccgtcacgtccccgagggaacggcccgtggagtggcttgcacacatcttctcgaatagaacgaaaatcctaacagtacatctctagaagagactaagtttaaccatcctaccaacggaccaacctaccgaaaaggcaggtggttactttagtatacgaaccaacagtacggaccctgacggacaccgaggacaacaatacttaacgtgtgacgaaacgggtaagtaggaacggggaaagaaacgagtcgttaggtttctagttaattaattaagttaccttaaccattcgtagggacgttcggtagggggaaccgaaacggggggaccctaccggggtacctacccggttcctcccgtacgtaccggtacccttaccccgaaacccggaaacggggtccccctaaaggttccccggttccccgtttcccccggtcgggttccccgtcccccgtcggttaccccgttcccggaaacgggcccggtaccctaaccccggttccggggcgggggaccaacccggcgggtcccccgggg

SEQ ID NO: 438163 - DNA, 588 bp, Homo sapiens
  misc_feature: GZ8MTXP01ETJLR.44.36.D03.1.454.CMB.2.raw
  modified_base (310)..(310): a, c, t, g, unknown or other
  modified_base (380)..(380): a, c, t, g, unknown or other
  modified_base (397)..(397): a, c, t, g, unknown or other
  modified_base (479)..(479): a, c, t, g, unknown or other
  modified_base (517)..(517): a, c, t, g, unknown or other
  modified_base (556)..(556): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacttggtccagcctgggagggtccctgagactctcctgtgtcgcctctggatcaccatcagtgaccactatatggactgggtccncaggctcgaggggagggctggagtggcttcggccacgaagtaaaaaacaagttcgacccaagtctttaancacgagacgtacgccgngtctagtagaaacgccagtacttccgaccctctacgaaagacgactgaacttacaaaggaacttactaatttacgatttcgngtacgaaatcgaaacctaaaccgtaacggaaaaccggnggaacgacggggtacagttaggtaatttagttgttgttnttagtttaactatcgaaggtaacttgtaaccg

SEQ ID NO: 438164 - DNA, 609 bp, Homo sapiens
  misc_feature: GZ8MTXP01D71JK.44.36.D03.1.454.CMB.2.raw
  modified_base (224)..(224): a, c, t, g, unknown or other
  modified_base (385)..(385): a, c, t, g, unknown or other
  modified_base (435)..(435): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctgggagggtccctgagactctcctgtgtcgcctctggatcaccatcagtgaccactatatggactgggtccgccaggctccgaggggaagggggctgggagtggcttggccgacaagtaaaaacaaggttgacccaaagccttttaancaacgagacgtacgcgcgtctagagaaacgccaagtacttcccaaccctntacgaaagagactgtaaccttacgaaacggtaacttctaatttcgacttcgtagacgtaaatcgtaaaccgtaaaccgtaacggaaaaaccggaaggaaccgaacgggtacttaagttagttaatttagttgttgtttgttagtttaatactacgaaggtaacttcggtaaccg

SEQ ID NO: 438165 - DNA, 556 bp, Homo sapiens
  misc_feature: GZ8MTXP01D4G1J.44.36.D03.1.454.CMB.2.raw
  modified_base (307)..(307): a, c, t, g, unknown or other
  modified_base (344)..(344): a, c, t, g, unknown or other
  modified_base (378)..(378): a, c, t, g, unknown or other
  modified_base (453)..(453): a, c, t, g, unknown or other
  modified_base (465)..(465): a, c, t, g, unknown or other
  modified_base (493)..(493): a, c, t, g, unknown or other
  modified_base (528)..(528): a, c, t, g, unknown or other
  modified_base (535)..(535): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggaggtccgggggagacgttggtccagccgtggagggtccctgagactctcctgtgtcgctctggatcacatcagtgaccatatatggactgggtccncaggctccgaggggagggctgggagtggcttggccanaaaggtaaaaaacaagttgcccaaagtctttaancaacagacgtaccgccgacgtctgtagaaagccagacttcaccctctacaaagagatgaacttacaaaggaactnaattgaatttcngacgaaatgaactaaaccagaaaaccgnggaacagggacagtagtattagttgttgtttggtntttaatntacgaggtaacttgtaacccg

SEQ ID NO: 438166 - DNA, 546 bp, Homo sapiens
  misc_feature: GZ8MTXP01CLY5N.44.36.D03.1.454.CMB.2.raw
  modified_base (326)..(326): a, c, t, g, unknown or other
  modified_base (472)..(472): a, c, t, g, unknown or other
  modified_base (490)..(490): a, c, t, g, unknown or other
  modified_base (521)..(521): a, c, t, g, unknown or other
  modified_base (523)..(523): a, c, t, g, unknown or other
  modified_base (539)..(539): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgaacgaaaaatcctacagtacatctctgaagagcagtttaaccatctaccaaggacacctaccaaaaggcaggtgtctttagtatgaccaanatggaccctgcgacaccaggcacatattaactgtgacaacgggtaaatggaacgggaaaagaaacagtcgttggtttctagttattaataagtcttacatcgtggacgtcgtaggggacaaagggggacctacggtcacgtctccncagtctccacacggcccntcggtccttcccctgccgccctgcttcagcncnccgtcgcgggcaacgngtcccgg

SEQ ID NO: 438167 - DNA, 573 bp, Homo sapiens
  misc_feature: GZ8MTXP01DSEC0.44.36.D03.1.454.CMB.2.raw
  modified_base (379)..(379): a, c, t, g, unknown or other
  modified_base (430)..(430): a, c, t, g, unknown or other
  modified_base (447)..(447): a, c, t, g, unknown or other
  modified_base (457)..(457): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggatcaccatcagtgaccactatatggactgggtccgccaggctccgaggggaaggggctgggagtggcttggccgacaagtaaaaacaagttgcccaagtctttaanacacagacgtaccgcgcgtctgtagaacgcagtactaccacctcacaaganatgacttacaagtactntattgattcngactaatcgtaaacctaaacgaagaaaaccggaaggacgacggattaagttagttaatttagttggttagtttaagttacgtttaatacgtacgaaggttaaccttcggtaacccg

SEQ ID NO: 438168 - DNA, 562 bp, Homo sapiens
  misc_feature: GZ8MTXP01EEUWL.44.36.D03.1.454.CMB.2.raw
  modified_base (223)..(223): a, c, t, g, unknown or other
  modified_base (438)..(438): a, c, t, g, unknown or other
  modified_base (505)..(505): a, c, t, g, unknown or other
  modified_base (515)..(515): a, c, t, g, unknown or other
  modified_base (531)..(531): a, c, t, g, unknown or other
  modified_base (544)..(544): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgctctggatcaccatcagtgaccactatatggactgggtccgccgaggctccgaggggaaggggctgggagtggcttggccgacaaggttaaaaaacaaagttcgacccaagtctttaagcaacagaacgtaccgccgcggtctggtacaaaggcccaagacttccaacccctntacaaagagatgaacttcaaaggaactcaattgattctgacgtaatgaaactaacctagaaaaccgnggacacgggnagtgtaattgttgttntgtgtttaactancgaggtaacttgtaaccg

SEQ ID NO: 438169 - DNA, 654 bp, Homo sapiens
  misc_feature: GZ8MTXP01BHT2J.44.36.D03.1.454.CMB.2.raw
  modified_base (323)..(323): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaaatcctaacagtacatctctagaagagctagtttaaccatctaccaagacacctacaaaggcagtgtacttagatgaccaanatcgaccctgcggacaccgaggcaacatacttaactgtgcgaaacgggtaataggaacggggaaaagaaacgagtacgttaggtttcttaggttaatttaattaaagttacctttaaccattcgtaggtaccgtcgtaggggacgaaacgggggaccacgggtccaacccgtctcccgtacgacgtaccttcccgaaccgtaccgggcccctaacggtcccgggttcccttcccccggtggccccgtccccgttcgccccgttcccgacgggtaacccggccctaacccggttccggtcggggggaccccaacgggcccggtcccccgggg

SEQ ID NO: 438170 - DNA, 571 bp, Homo sapiens
  misc_feature: GZ8MTXP01BXVS0.44.36.D03.1.454.CMB.2.raw
  modified_base (394)..(394): a, c, t, g, unknown or other
  modified_base (542)..(542): a, c, t, g, unknown or other
  modified_base (544)..(544): a, c, t, g, unknown or other
  modified_base (561)..(561): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatgaacgaaaatcctacagtacatctctgaagagcagtttaaccatctaccaaggacacctacaaaaggcaggtgtctttagtatgaaccaacagtcggaccctggccggacaccgaggcactatattaactgtgcgaacggggtaatggacgggaaanaaacgagtcttaggtttctgttaattaataagttacttacatcgtgacgtcgtgggacgaaagggggccacggtccaccgtctcctcgacgctccaccgacggcccatccggtccttccccgtcggccgcccgtgccttccgacggcncncccgtcggcggggaccncgcgcccggg

SEQ ID NO: 438171 - DNA, 568 bp, Homo sapiens
  misc_feature: GZ8MTXP01C572X.44.36.D03.1.454.CMB.2.raw
  modified_base (323)..(323): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctccaaggacacctaccaaaaggcaggtgtctttagtatgaccaantggaccctgcgacacaggcacatattaactgtgcgacgggtaatggacgggaaagaaacgagcttggtttctagtattataagtacttacatcgtggacgtcgtagggacgaaagggggaccacggtccaccgtctcctcacgtccttccaccgacggcccacgtccggtcccttccccgtcggccgtcccgtcgcccgttccgacggcgccaacccgtcggtcgggggccaacgcggccccggg

SEQ ID NO: 438172 - DNA, 521 bp, Homo sapiens
  misc_feature: GZ8MTXP01A2CDZ.44.36.D03.1.454.CMB.2.raw
  modified_base (295)..(295): a, c, t, g, unknown or other
  modified_base (419)..(419): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagttcagggcagagcaccatgaccagggacacgtccacgagcacagcctacatgganctgagcagtcagagactctgaggacataagatgtgtactactgtgcgagaccggtagaggaacaagacaaagaaagtaagttcttttagactacgtgggaccagggaaccctggggtcacgtcncctcacgcctccacgacggcccagtccggtcctcccctggccacccttcctaccgaacgacgccaccgtcgcgggggcacgacgccgggcccgttgggtccg

SEQ ID NO: 438173 - DNA, 596 bp, Homo sapiens
  misc_feature: GZ8MTXP01BMCWH.44.36.D03.1.454.CMB.2.raw
  modified_base (389)..(389): a, c, t, g, unknown or other
  modified_base (441)..(441): a, c, t, g, unknown or other
  modified_base (449)..(449): a, c, t, g, unknown or other
  modified_base (461)..(461): a, c, t, g, unknown or other
  modified_base (471)..(471): a, c, t, g, unknown or other
  modified_base (520)..(520): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccagccgtgggagggtccctgagactctcctgtgtcgcctctggatcacatcagtgaccactatatggactgggtccgccaggcctccgagggggaaggggctgggagtggcttgggccgacaaagtaaaaacaagttgaccctaagtcctttaancagagacgtaccgccgtcgtctaggtagaaacgccaagtacttaccaccctntacaaganatcgtaacttanaaaggtactntattagacttcgagactaaatcgtaaacctaaacgtaacggaaaaccgnggaacgacgggtattagttagtatttagttggttcgtttaagttagtttaactagtacgaaggtaacttcgtcccg

SEQ ID NO: 438174 - DNA, 607 bp, Homo sapiens
  misc_feature: GZ8MTXP01AS6S9.44.36.D03.1.454.CMB.2.raw
  modified_base (374)..(374): a, c, t, g, unknown or other
  modified_base (418)..(418): a, c, t, g, unknown or other
  modified_base (425)..(425): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacgttggtccagcctggagggtccctgagactctcctgtgtcgcctctggatcaccatcagtgaccactatatggactgggtccgccaggctccgaggggaaggggctgggagtggcttggccgcaagtaaaacaagtgccaagtctttaancacagacgtaccgcgcgtctgtagaaagccagtacttcaccctntacaagngatgacttacaaaggtaactctaattgaatttcctggaccgtaaattcgaaaccttaaaccgtaaggaaaaccccggaagggaacccaacgggggtacaagtttacggtaattttagtttggtttaggtttggtttgttttaaacctagttacccgaagggttaacctttcgggtaaccccg

SEQ ID NO: 438175 - DNA, 570 bp, Homo sapiens
  misc_feature: GZ8MTXP01EIJBC.44.36.D03.1.454.CMB.2.raw
  modified_base (272)..(272): a, c, t, g, unknown or other
  modified_base (277)..(277): a, c, t, g, unknown or other
  modified_base (315)..(315): a, c, t, g, unknown or other
  modified_base (335)..(335): a, c, t, g, unknown or other
  modified_base (361)..(361): a, c, t, g, unknown or other
  modified_base (536)..(536): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccactgtgaggtgcggctgggtggagtcgtgggggaggcgttgggtacgagggcggggggggtccctggagactctcctgtgcngcctnggattcatcttcagtgactatgccatgaactgggtccncaggctcgagggaggctggngtggttcatatgttaatatgctgganactaccactactacgcagtactcgtggtagaaacgggcctaatttaccaacctaaattcccgaaagggaacctaaagtacgacccaaaggtaaactctaacttagtaactacgtaggaaaatacggaaaccagccgtagagaaggacgaggacacggcttacgttcttacttcgngttacgaagagtacgccgggtccttaagtttggg

SEQ ID NO: 438176 - DNA, 634 bp, Homo sapiens
  misc_feature: GZ8MTXP01AY6CD.44.36.D03.1.454.CMB.2.raw
  modified_base (216)..(216): a, c, t, g, unknown or other
  modified_base (301)..(301): a, c, t, g, unknown or other
  modified_base (377)..(377): a, c, t, g, unknown or other
  modified_base (395)..(395): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtgggtttccttgttgttatttacaaggtgtccagagtgaagtgcagttggtggagtccggggganacttggtccagcctggagggtccctgagactctcctgtgtcgcctctggattcaccatcagtgaccactatatggactgggtccnccaggctccgaggggaagggggctgggagtgggcttgggccgtacaagtaaaaacaaggttcgaccagtctttaancaacagcgtacgcgcgtngagaacgcatactccacctcacaagagatacgtacttaacgaaacgtaactactatttggaactttcgagacgtaaatcgaaacctaaaccgtaaacggaaaacccggtagggaaccgaacgggactaagttacgttaagtttagttggtttagtttggtttagttttaacgttacgttaacggaaacggtaaccgtccggacccggttaacgggtcccgggggaacccgtaaccgggg

SEQ ID NO: 438177 - DNA, 613 bp, Homo sapiens
  misc_feature: GZ8MTXP01CB6NW.44.36.D03.1.454.CMB.2.raw
  modified_base (349)..(349): a, c, t, g, unknown or other
  modified_base (376)..(376): a, c, t, g, unknown or other
  modified_base (428)..(428): a, c, t, g, unknown or other
  modified_base (449)..(449): a, c, t, g, unknown or other
  modified_base (460)..(460): a, c, t, g, unknown or other
  modified_base (517)..(517): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccgggggagacttggtccagcctggagggtccctgagactctcctgtgtcgcctctggattcaccatcagtgaccactatagtggactgggtcccgccgaggctccgaggggaagggggctgggagtgggcttggccganaagtaaaacaagttcgccagtctttancaaacagcgtacgccgcgtctggtagaaacgcccaagactttccaccccttntacgaaagagatgaaccttanaaagtaacctnaatttggaatttcgtagacgtaaatcgaaaccttaaaccgtaaggaaaaaacccggnggaaccgacgggctaagttgttaatttagttgttgtttgttagtttaattagttaagaggtaacttggtacccaggtcgggggaaccctaacgggg

SEQ ID NO: 438178 - DNA, 562 bp, Homo sapiens
  misc_feature: GZ8MTXP01DL5MM.44.36.D03.1.454.CMB.2.raw
  modified_base (226)..(226): a, c, t, g, unknown or other
  modified_base (284)..(284): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaacttgtctctgtatcaacatcatccaaggtaaacncccccaaatcatcatctatgagcctataagagccctgagggtttctaactcgcttcactcgacctcaagtccgacaacacgcctcctgacatctctgggctccgagctgaggacgagctagtatttattagttgttagcttacgagtattgttcgtcgtctatctactttattcgttacgttcgggtaaaggttcgggaaccgtaagggttcccgttaccggttccgttaagggtccaaccggacccgaacgggaccccaaaccccgttcgttaaccg

SEQ ID NO: 438179 - DNA, 566 bp, Homo sapiens
  misc_feature: GZ8MTXP01EO055.44.36.D03.1.454.CMB.2.raw
  modified_base (268)..(268): a, c, t, g, unknown or other
  modified_base (358)..(358): a, c, t, g, unknown or other
  modified_base (373)..(373): a, c, t, g, unknown or other
  modified_base (391)..(391): a, c, t, g, unknown or other
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccgggggagacttggtccagcctggagggtccctgagctctcctgtgtcgctntggatcaccatcagtgaccactatatggactgggtccgcaggctccgaggggaagggctgggagtggctggccacaagtaaaaacagttncccaaagtctttaancaacgagagtaccgccgngtctgtagaaatccaagacttcaacccctntacaagagatgaacttacaaaggtaacttcaattgtaattccgtagacgtaaatcggaaaccttaaaccaggaaaacccgaagggacttaaggggcttagtgtatttagttgttgttgtatttaacatcaggtaacttggtaacc

SEQ ID NO: 438180 - DNA, 709 bp, Homo sapiens
  misc_feature: GZ8MTXP01BG7VG.44.36.D03.1.454.CMB.2.raw
  modified_base (393)..(393): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcttgttgttatttacaaggtgtcagagtgaagtgcagttggtggagtccgggggagacttggtccagccgtggagggtccctgagactctcctgcgtcgctctggatcacatcagtgaccactatatggactcgggtccgcgaggctaccgagggggaagggggctgggagtggcgttgggaccgacaaaggtaaaaaacaaagttcgacccgtaaagtaccttttaanactaacgaacggtacgtaccgccgtacgttacgtaggtaacgaaacgccgtaagtaccttacccaaccccgttctaacaaaggacgtaagttacgtaaccttaacgaaaacgggtaactacgttaagtttacgtaactttcgtaggtaacgtaaacgttaaccgtaaaccgtaaaacccgtaaacgggaaaaacccgggaaggtaaaccgaacgggtacttaaggtttaacgtttaagttttagtttggttaggttttaaggtttaacgttttaacgtaacgttacggttaaacggttaaccgttcggtaacccgg

SEQ ID NO: 438181 - DNA, 709 bp, Homo sapiens
  misc_feature: GZ8MTXP01BI7A4.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatgaacgaaaatcctaacagtacatctctagaagagctaagtttaaccatcctaccgaaggaccacctacgaaaaggcaggtgtctttagtatgaccaacatcggaccctgcggacacaggcacatattaactgtgacgaacggggtaatcgggaacgggaaaacgaaacgaggtcgttagggttttactaggttaatttaagttaaacgttacctttaaccctattaccggtagggtaaaccggttcggtaacggggggtaccgtaaaacggggggggaccccgtaacggggttacccgtaaccccggttcctaccccgtacgacgttcccgttaccccgaacccgtaaacggggtcccctaagttccccgggttcccctttcccccggcggccccgtccccgtcggcccgttcccgacggaacggtccctaacccggttcgggtcgggggaccctaacggccgggccccggg

SEQ ID NO: 438182 - DNA, 524 bp, Homo sapiens
  misc_feature: GZ8MTXP01B18RY.44.36.D03.1.454.CMB.2.raw
  modified_base (270)..(270): a, c, t, g, unknown or other
  modified_base (308)..(308): a, c, t, g, unknown or other
  modified_base (350)..(350): a, c, t, g, unknown or other
  modified_base (455)..(455): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaagtgtccactgtgaggtgcggctggtggagtcgtgggggaggcttgggtacaggcggggggggtccctgagactctcctgtgcagcctcnggattcatcttcagtgactatgccatgaactgggtccncaggctccgagggagggctggagtgggtttcatatgttaatntgctggagatacccactactacgcagactctggtagagggccagttccacctaattcccgagggacaagtcgaccaaggaactcactgtatcgtaggaatgaacngcctgagaagacgaggacacggctgttcttcttcgtgttcgaagtaggagttcgggcccttaagttggg

SEQ ID NO: 438183 - DNA, 595 bp, Homo sapiens
  misc_feature: GZ8MTXP01D6KBL.44.36.D03.1.454.CMB.2.raw
  modified_base (263)..(263): a, c, t, g, unknown or other
  modified_base (437)..(437): a, c, t, g, unknown or other
  modified_base (503)..(503): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtggtttctgttgttatttacaaggtgtcagagtgaagtgcaggttggtggaggtccgggggagacttggtccagccgtgggacgggtccctgagactctcctgtgtcgcctntggattcaccatcagtgaccactatatggactgggtccgcgaggctccgagggaagggctgggagtggcttggccgacaaagtaaaaacaagttcgaccagtctttatcaaacagaagtacgccgcgtctgtagaaacgccagattccacctctacaagagatgacttacaaanactctattgtatttcgtagacgtaatgaaccttaaacgaacgaaaacccgtggaaaccgacggggnaattggttatttaagtttgttagtttggttagttttacttattcaaagggtaacttcggaccttaacgggttcggggaacccgtaaccgggg

SEQ ID NO: 438184 - DNA, 608 bp, Homo sapiens
  misc_feature: GZ8MTXP01C1QCV.44.36.D03.1.454.CMB.2.raw
  modified_base (426)..(426): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggcccctggagtggcttgcacacatcttctcgaatgacgaaaatcctacagtacatctctgaagagcagtttaaccatctccaaggacacctccaaaaggcaggtggtactttagtatgaccaacatggaccctgcggacaccaggcacatattaactgtgcgaacgggtaataggacgggaaagaaacagcttggttctgtattaataagtcttaaccgattcgnggacgtcgtaggggactaaacggggggacccacggggtaccaaccggtcctcccgtcacgtcccttccgaaccaacgggccccaagtcccgggttcccttcccccgtcggcccggtcccctcggttcccttccgacggaaccgccgaacccgtcggtcgggggaccaacgaacggccccggg

SEQ ID NO: 438185 - DNA, 591 bp, Homo sapiens
  misc_feature: GZ8MTXP01CHOD5.44.36.D03.1.454.CMB.2.raw
  modified_base (371)..(371): a, c, t, g, unknown or other
  modified_base (378)..(378): a, c, t, g, unknown or other
  modified_base (391)..(391): a, c, t, g, unknown or other
  modified_base (419)..(419): a, c, t, g, unknown or other
  modified_base (537)..(537): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagactggtccagcctggagggtccctgagactctcctgtgtcgcctctggattcaccatcagtgaccactatatggactgggtccgccaggctccgaggggaacgggctgggagtggcttggtcgacaagtaaaaacaagttcgaccagtctttancaacagngtacgccgcgtcngtagaaagcccaagacttccaacccctntacaaagagtatgaacttcaaagtaactcattaggactttctgacgtaaatcgaactaacgtagaaaaccgtggaacacggggcaagttgttatttagttgttgttgttacgttttanagtcgaagggtaaccttggtaccccttaacggtcgggggaaccgtaaaccgggg

SEQ ID NO: 438186 - DNA, 599 bp, Homo sapiens
  misc_feature: GZ8MTXP01BEMMX.44.36.D03.1.454.CMB.2.raw
  modified_base (443)..(443): a, c, t, g, unknown or other
  modified_base (452)..(452): a, c, t, g, unknown or other
  modified_base (484)..(484): a, c, t, g, unknown or other
  modified_base (519)..(519): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtgggaggtccgggggagtacgttggtccagccgtgggacgggtccctgagactctcctgtgtcgcctctggatcaccatcagtgaccactatatgggactcggggtcccgccaggcctccgagggggaaggggctgggagtggcttgggccgacaaagtaaaaacaagttcgacccaagtctttaatcacgagacgtaccgcgcgtctgtagaaacgccagtacttacaccctntacaacganatgacttacgaaggaactcgaatttgaattcngactaaatcgtaaactaaaccgtaggaaaacccgngggaacacggggtacagtagttaatttagttggttagtttgttagtttaattactacgttagggtaacttcggtaacccg

SEQ ID NO: 438187 - DNA, 638 bp, Homo sapiens
  misc_feature: GZ8MTXP01AOW90.44.36.D03.1.454.CMB.2.raw
  modified_base (212)..(212): a, c, t, g, unknown or other
  modified_base (259)..(259): a, c, t, g, unknown or other
  modified_base (276)..(276): a, c, t, g, unknown or other
  modified_base (327)..(327): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtggtttcgtgtagttatttacaagtgtcagagtgaagtgcagttggtggagtccggggganacttggtccagcctgggagggtccctgagactctcctgtgtcgcctntggattcaccatcagtnaccatatatggactgggtccgccagggtccacgagggggaagggcgtgggnggtggcgtcggcgacgaaacgtaaaacgtaaagtacgactagtacttatacaacagaacgtacgaccgcgtcgtagtagaacgacatactacctacctactacaagagatactactactaaacgtaactactaatagtacttacgtacgtacgtaacgtaacgtaaccgtaaaccgtaaacgaaaaccggtaaacggaacggaaccggtacgtaagttagttaagtttagtttaggttagtttagtttagtttattacgtaacgtaacggtaacgtacgtacgttacggtcgggttaaccgggtaaccggg

SEQ ID NO: 438188 - DNA, 639 bp, Homo sapiens
  misc_feature: GZ8MTXP01BCPN6.44.36.D03.1.454.CMB.2.raw
  modified_base (381)..(381): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggatcaccatcagtgaccactatatggactggggtccgccaggctccgagggggaaggggctgggagtggcttggccgccaagtaaaaacaagttgacccaagctttaancacgagacgtaccgcgtcgtctagtagaaacgccaagtacttcccaaccccttctaacaaaggagtacttacgtaaccttacaaacgggtaacttctaagtttacgtactttccgaggtaaccgtaaagtcgtaaacccttaaaccgtaaacgggaaaaacccggaagggaacccgacggggtacttaagttaggttaatttagtttggttaggtttgttagtttaatacgtacgttaaggtaaccttcggtaacccg

SEQ ID NO: 438189 - DNA, 549 bp, Homo sapiens
  misc_feature: GZ8MTXP01CXKRY.44.36.D03.1.454.CMB.2.raw
  modified_base (204)..(204): a, c, t, g, unknown or other
  modified_base (422)..(422): a, c, t, g, unknown or other
  modified_base (518)..(518): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggacccccggnagagggtcatcatctcttgttctggaagcagttccaacatcggccctaaattctgtatattggtaccagcaagtcccaaggaaccgcccccaaactcctcatctataggactaatcagcgccctcgacggggtccctgaccgattcctcctggctccaagtctaggccaacctcagccctcctggccatcagtcggccccggtcgaggaccgaggttnattacactgcgcagcgttggggatcgaccgccgtggacggtcgttggctggtcggacggacggaccaaagtcgaccgtccaggtcagcccgagccncgcccctgtccacttctccgttccctaaccc

SEQ ID NO: 438190 - DNA, 634 bp, Homo sapiens
  misc_feature: GZ8MTXP01A5TA7.44.36.D03.1.454.CMB.2.raw
  modified_base (428)..(428): a, c, t, g, unknown or other
  modified_base (462)..(462): a, c, t, g, unknown or other
  modified_base (550)..(550): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagcccgtgggacgggtccctgagactctcctgtgtcgctctggatcacatcagtcgaccactatagtggacgtcgggtccgccgaggcctaccggagggggaacgggggcgtgggagtcgggcttcgggcccgacaaaggtaaaaaacaaggttcgaccctaaagtctttaagcaacgagacgtacggccgngtctgtagaaacgccaagtacttccaaccccttntacaaagagatagtaacttaccaaaggtaacttctaattagaacttccgagacgtaaatcggtaaacctaaccgtaacgaaaacccgnggaaccgacggggtacagttagttaatttagttggttagtttggttgtttaactgtacgttaacgggtaacttcgggtaacccg

SEQ ID NO: 438191 - DNA, 538 bp, Homo sapiens
  misc_feature: GZ8MTXP01AVQ5X.44.36.D03.1.454.CMB.2.raw
  modified_base (248)..(248): a, c, t, g, unknown or other
  modified_base (322)..(322): a, c, t, g, unknown or other
  modified_base (351)..(351): a, c, t, g, unknown or other
  modified_base (364)..(364): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctanagtacatctctgaagagcagtttaaccatctaccaaggacacctacaaaaggcaggtgtcttagtatgaccaanatggacctgcgacacaggcacatataacngtgcacgggtaanggacgggaaagaaacagtctggtttctgtattataagttacttacatctggacgtcgtaggggacaaagggggacacggtccaccgtctcgtcagctccacacggccatccggtcttccccgtgccgccctcgccgttcgcggaacgcaaccgtcgcgggggcaacgcgcccgg

SEQ ID NO: 438192 - DNA, 582 bp, Homo sapiens
  misc_feature: GZ8MTXP01ED0UO.44.36.D03.1.454.CMB.2.raw
  modified_base (323)..(323): a, c, t, g, unknown or other
  modified_base (356)..(356): a, c, t, g, unknown or other
  modified_base (554)..(554): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaacggccctggagtggcttgcacacatcttctcgaatgaacgaaaatcctacagtacatctctgaagagcagtttaaccatctcaaggacacctaccaaaagcaggtggtctttagtatgaccaanatggaccctgcggacaccaggcacatattaacngtgcacggggtaatggacgggaaagaaacagtcgtgtttctgtattaataacgttacttaccattcgtggacgtcgttaggggacgaaaggggggacccacgggtccaccggtctcctcgacgtccttcccgacccgaacgggccccagtcccggttccttcccccgtggcccgccctcgccgttccgacggcgaccnccgtcgggtcggggcaacgcggcccggg

SEQ ID NO: 438193 - DNA, 583 bp, Homo sapiens
  misc_feature: GZ8MTXP01EXJ0O.44.36.D03.1.454.CMB.2.raw
  modified_base (306)..(306): a, c, t, g, unknown or other
  modified_base (378)..(378): a, c, t, g, unknown or other
  modified_base (503)..(503): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgctctggatcacatcagtgaccatatatggactgggtccncaggctccgagggagggctgggagtggcttggccgacaaaggtaaaaaacagttcgacccaaagtctttaancaacgagacgtaccgccgcgtctagtagaaacgccaagacttccaaccctcgtacaagagatgaacttacaaaggtaactctaattgactttcttacgaatcgaacctaaaccgtagaaaaccgnggaacacggggctaagttgtaatttagttggttgtttagttgtttaactaagtcgaaggttacttcggttccgaacgggg

SEQ ID NO: 438194 - DNA, 544 bp, Homo sapiens
  misc_feature: GZ8MTXP01BI369.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagactctgaggacataagatgtgtactactgtgacgagaccgtagagacaagacaaagaaagtagttactttagactacgtacgggaccaagggaacccgtggggtacctaccggtcctccgtcaccgccctaccgaccgacggtcccacgtccggtccctccccgtcggcccaccccttccgtccaacgacgccgaccgtcggcggggccacgacggccggccgttcgggtccg

SEQ ID NO: 438195 - DNA, 657 bp, Homo sapiens
  misc_feature: GZ8MTXP01C3XPW.44.36.D03.1.454.CMB.2.raw
  modified_base (218)..(218): a, c, t, g, unknown or other
  modified_base (280)..(280): a, c, t, g, unknown or other
  modified_base (351)..(351): a, c, t, g, unknown or other
  modified_base (388)..(388): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctggtttcctgttgttatttacaaggtgtcagagtgaagtgcagttggtggagtccggggganacgttggtccagcctgggagggtccctgagctctcctgtgtcgcctctgatcaccatcagtnaccatatatggactcgggtccgccgaggcctccgagggggaagggggtctggggagtggcttgggcccganaaaggtaaaaaacaaggttcgccctaaagtctttaancaacgaggacgtaccgccgtacgtctgtagaaagcccagacttccaccctctacaaagagatacgtaacttacgaaacggtaaccttcgtaagtttagaactttccgtagaccggtaaatccggtaaaacctaaacccgttaacgggaaaaaacccggtaacgggaaccgaaccgggggaccttagtttaaggttaaatttacgtttggtttaggtttggttttattttaagtaaccgttcgttaaggtaaccgttcgttaaccccggg

SEQ ID NO: 438196 - DNA, 823 bp, Homo sapiens
  misc_feature: GZ8MTXP01CX8P6.44.36.D03.1.454.CMB.2.raw
  modified_base (248)..(248): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaagcctggagtggcttgcacacatcttctacgaatgaacgaaaatcctanagtacatctctagaaagagactaagtttaaaccatacctaccgaaaggaccaacccgtaccgaaaaaggcgtaaggtgggttactttaagtatcgaaacccaaacacgtcggaacccctggaccggaacaacccgagggacaactaattaacgttaaactgtcgacgtaaacggggtaaataggggaaccgggaaaagaaaccgaaggtccgtttagggtttaccttaagggttaaatttaacgttaaacggttaccctttaaccgtagttacccgggttagggaacccggtttacgggtaggggggtaaaccctaaaacgggggggggaccccgtaaaccggggtttccaaccccgggttctacccccgttagaaccgggtaccctttaccccgaaacccgtaaaccgggggccccttaaagggttcccccgggtttaccccgttttcccccccccggggtcgggttcccccgtccccgttacggttaccccgttacccgggaaccggtaaccggtacccctaacccgggttccggggtacgggggaccctaaccggttcccgggggccccggg

SEQ ID NO: 438197 - DNA, 571 bp, Homo sapiens
  misc_feature: GZ8MTXP01AXN64.44.36.D03.1.454.CMB.2.raw
  modified_base (319)..(319): a, c, t, g, unknown or other
  modified_base (349)..(349): a, c, t, g, unknown or other
  modified_base (562)..(562): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagctagttaaccatctaccaaggacacctacaaagcaggtgtcttagtatgacaantagacctgcgacaccagcacgatattaacngtgcgacgggtaatggacgggaaacgaacagcgtgttctagtatataagtcttacatctggacgtcgtagggacaaacgggggaccacgggtcaccgtctccgtcacgtccttaccgaccgaacggcccagtccggttcccttcccccggtcggcccgtcccgtcgttcccgttcccgagggccgccgaacccggttcgcgggggcaaccggnggccccggg

SEQ ID NO: 438198 - DNA, 651 bp, Homo sapiens
  misc_feature: GZ8MTXP01EKX90.44.36.D03.1.454.CMB.2.raw
  modified_base (214)..(214): a, c, t, g, unknown or other
  modified_base (339)..(339): a, c, t, g, unknown or other
  modified_base (366)..(366): a, c, t, g, unknown or other
  modified_base (382)..(382): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggtttcctgttgttatttacaaggtgtcagagtgaagtgcagttggtggaggtccggggganacttggccagcctggaggtcctggagctctcctgtgtcgcctctggattcaccatcagtcgaccatatatggacgtcgggtccgcaggcctccgaggggaagggctggagtgggcttggccgtanaagtaaaaacagtcgaccagtctttancaacagcgtacgccgngtctgtagaaacgtcccagtacttcccaaccctctacgaaaggaagtacttagtaaccttaaacgaaacgtaacttacgtagtttacggtaactttcgtacgtaacgtaaactaacgtaaaccgttaaaccgtaaacggaaaaccggtaacgggaaccgtacgggaactaagttagtttaagtttagtttgttaggtttagttagtttacgttagttaacggacggtaacgttcgacccgttacggggtaaccgggaacccggtaacgg

SEQ ID NO: 438199 - DNA, 558 bp, Homo sapiens
  misc_feature: GZ8MTXP01EIXVA.44.36.D03.1.454.CMB.2.raw
  modified_base (302)..(302): a, c, t, g, unknown or other
  modified_base (374)..(374): a, c, t, g, unknown or other
  modified_base (421)..(421): a, c, t, g, unknown or other
  modified_base (448)..(448): a, c, t, g, unknown or other
  modified_base (494)..(494): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgtatttacaaggtgtccagagtgaagtgcagttggtggagtccgggggagacttggtccagcctgggagggtccctgagactctcctgtgtcgcctctggatcaccatcagtgaccatatatggactgggtccnccaggctcgaggggagggctggagtggcttggccgaccaaggtaaaaaacaaggttgcccaaagtctttaancacaggagtaccgccgtcgtctgtagaaagccagacttcaacccctntacaagagatgacttcaaaggaacttntattgacttctgacgtaatcgtaacctaaccgtaacgaaaaccggnggaacgacgggacagtagttattagttgttgttgttatttaatctcgaggtaacttcgtaaccg

SEQ ID NO: 438200 - DNA, 607 bp, Homo sapiens
  misc_feature: GZ8MTXP01ETFUD.44.36.D03.1.454.CMB.2.raw
  modified_base (408)..(408): a, c, t, g, unknown or other
  modified_base (465)..(465): a, c, t, g, unknown or other
  modified_base (508)..(508): a, c, t, g, unknown or other
  modified_base (543)..(543): a, c, t, g, unknown or other
  modified_base (580)..(580): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccagccgtgggagggtccctgagactctcctgtgtcgctctggatcacatcagtcgaccactatagtggacgtgggtcccgccaggcctccggagggggaacggggctgggagtggcgttgggacccgaaccgaaaggttaaaaaaacaaggttcgaccctaaagtccttttaancaaaccgaggacgtaccgccggtcgtactgtagaaacgccaagacttccaacccctntacaagagatcgaacttacaaaggtaactcaattgaactttcngactaaagtcgtaaacctaaccgtacgaaaaccgnggaacgacgggattagtgttattagttgttgtttgtntttaatactcgaggtaacttgtaaccg

SEQ ID NO: 438201 - DNA, 519 bp, Homo sapiens
  misc_feature: GZ8MTXP01EZ4OV.44.36.D03.1.454.CMB.2.raw
  modified_base (335)..(335): a, c, t, g, unknown or other
  modified_base (373)..(373): a, c, t, g, unknown or other
  modified_base (498)..(498): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagttcagggcagagcaccatgaccagggacacgtcacgagcacagcctacatggagctgagcagtcagagatctgaggacataagatgtgtactacngtgcgagaccggtagagacaagacaagaaaagaagttntttagacgtaccgggcgagggaaccgtggtcgaccgtctcctcacgcctaccaccgaaacgggcccactccggtccttccccctcggccaccctcccttccaacgacgcaccttcgtcgggggcncgagcggcccgtcgggcgtcg

SEQ ID NO: 438202 - DNA, 653 bp, Homo sapiens
  misc_feature: GZ8MTXP01DUR1T.44.36.D03.1.454.CMB.2.raw
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggtccgccaggctccgaggggaagggctgggagtggcttgggcccgacaaaggtaaaaaacaaggttcgaccctaaagtccttttaanacgaacgaaggtacgtaccgccggtacgttacgtaggtaagaaacgccgtaagtaccttacccgtaaccccttacgtaacgaaagacgtaatacgtaaccttacgaaacggtaacttctaagtttacgtacttcgtagaacgtaaataccgtaaacctaaacccgtaacggaaaacccggaaggaaccgacgggtacttagttagttatttagttgttagtttgttagtttaactagtacgttaacggtaacgttcggtaaccg

SEQ ID NO: 438203 - DNA, 672 bp, Homo sapiens
  misc_feature: GZ8MTXP01B5D4S.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtcagagtgaagtgcaggttggtggaggtccgggggagtacttggtccagccgtggagggtccctgagactctcctgtgtcgctctggatcaccatcagtgaccactatatggactggtccgcaggctccgagggaagggctggagtgctggccgacaagtaaaaacaagttgacctaaagtctttaagcaaacgaggtacgtaccgcccggtcgtcgtagtagaaaacgtccaagtacttaccaaccccttctaacaaaggagatagtaaacttacgaaacggtaaacttacgtaatttaggtaactttcgtacggtaacggtaaaacttacgtaaacccgttaaaacccgtaaacggaaaaaaccccggaaagggaaaccgaacgggggtaccaaagtttagggttaattttaaggtttggttacggttttggtttaggttttaaactttagtacggttaacggtaaaccgtttcggtaacccgg

SEQ ID NO: 438204 - DNA, 585 bp, Homo sapiens
  misc_feature: GZ8MTXP01CGGJQ.44.36.D03.1.454.CMB.2.raw
  modified_base (271)..(271): a, c, t, g, unknown or other
  modified_base (388)..(388): a, c, t, g, unknown or other
  modified_base (522)..(522): a, c, t, g, unknown or other
  modified_base (527)..(527): a, c, t, g, unknown or other
  modified_base (532)..(532): a, c, t, g, unknown or other
  modified_base (558)..(558): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacttggtccagccgtggagggtccctgagctctcctgtgtcgcctntggatcaccatcagtgaccactatagtggacgtgggtcccgccaggctccgagggggaaggggctgggagtggcttggccgacaagtaaaaaacaagttcgacctaagtactttaanctaacgacggtagtaccgccgtacgtctaggtacgaaaacgcccaagtacttcccaccccttctacaaaggatatagactttacaaaggtaactcaattgattctgactaatcgaaacttaaccgagaaaccgngaacncgggnagttgtatttagttggttgttggttntttaatgtcgaggtaacttgtaacccg

SEQ ID NO: 438205 - DNA, 673 bp, Homo sapiens
  misc_feature: GZ8MTXP01CU4K1.44.36.D03.1.454.CMB.2.raw
  modified_base (385)..(385): a, c, t, g, unknown or other
  modified_base (541)..(541): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacttggtccagccgtggagggtccctgagactctcctgtgtcgcctctggatcaccatcagtgaccactatagtggactgggtccgccaggctccgaggggaaggggctgggagtggcttggccgacaaagtaaaaaacagttgacccaaagtctttaancaacaaggacgtacgccgtcgtctgtagaaacgccagtacttccaaccctctaccaaagagaatcgaactttacaaaggtaaacctctaattgtaacttccgtagtaccggtaaaattcggtaaaccttaaacccgtaacggaaaaaaacccgggngggaaaaccggaacggggtaccttaaaggtttaaacggttattttaaaggtttcgtttagggttttaagggttttacgttttaaatttaagtacggttaaacggggtaaacctttcgggttaaacccccggg

SEQ ID NO: 438206 - DNA, 622 bp, Homo sapiens
  misc_feature: GZ8MTXP01EG7OX.44.36.D03.1.454.CMB.2.raw
  modified_base (313)..(313): a, c, t, g, unknown or other
  modified_base (438)..(438): a, c, t, g, unknown or other
  modified_base (534)..(534): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccagccgtgggagggtccctgagactctcctgtgtcgcctctggatcaccatcagtgaccatatagtggactgggtccncaggcctccggagggggagggctgggagtggcttggccgacaaaggtaaaaacaggttcgacctaagtctttaagcaacgagacgtaccgccgtgtctgtagaaacgccagtacttccaaccctntacgaagagactcgaacttacgaaaggtaacttctaagtttgaacttccgtagacgtaaactcggtaaacccttaaaccgtaggaaaaaccccggngggaaaccaaccggggtacttaagttaggttaatttagtttggttacgtttgttagtttaatagtacgagtaaccgttggtaacccgg

SEQ ID NO: 438207 - DNA, 587 bp, Homo sapiens
  misc_feature: GZ8MTXP01BI65T.44.36.D03.1.454.CMB.2.raw
  modified_base (220)..(220): a, c, t, g, unknown or other
  modified_base (306)..(306): a, c, t, g, unknown or other
  modified_base (378)..(378): a, c, t, g, unknown or other
  modified_base (429)..(429): a, c, t, g, unknown or other
  modified_base (437)..(437): a, c, t, g, unknown or other
  modified_base (460)..(460): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaaggtgtccagagtgaagtgcagttggtggaggtccggggganacttggtccagcctgggagggtccctgagactctcctgtgtcgcctctggatcaccatcagtgaccactatatggactggggtccnccaggctccgaggggaggggctgggagtggcttggccgacaaggtaaaaacaagttcgcccaagtctttaancaacgagacgtaccgcgtcgtctagtagaaacgcagtacttacccaccctnacgaaganatcgtaacttacaaacggtactntattgtattcgagacgtaatacgtaaacctaaaccgaacgaaaaccggaaggaacgacgggtattagttagttaatttagttgttagttgttacgtttaatagtacgaggtaaccgttcggtaaccg

SEQ ID NO: 438208 - DNA, 609 bp, Homo sapiens
  misc_feature: GZ8MTXP01DCZGH.44.36.D03.1.454.CMB.2.raw
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgttggtccaggccgtgggacgggtccctgagactctcctgtcgtcgcctntggatcaccatcagtgaccactatagtggacgtgggtccgccaggctaccggagggggaacggggctgggagtcggcgttgggccgacgaagtaaaaaacaagttcgaccctaagtctttaatcaacgagtacgtaccgccgtcgtctagtagaaacgccagtacttaccaaccctctacaagagatgaacttcaaaggtaactctaattgattcagacgtaaatcgtaaacctaacgtaacgaaaacccggaagacgacgggtacagttagttatttaagtttgttaggtttgttagtttaatactacgttaggtaaccttcggtaacccg

SEQ ID NO: 438209 - DNA, 594 bp, Homo sapiens
  misc_feature: GZ8MTXP01BXJJ6.44.36.D03.1.454.CMB.2.raw
  modified_base (349)..(349): a, c, t, g, unknown or other
  modified_base (375)..(375): a, c, t, g, unknown or other
  modified_base (393)..(393): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagcccaccctcagtctcagtcggccccgaggggagaccggccaggtacttacctggtggggcgacgccggttggaaggtaaagtgtacagtgtaccagcagagccaggccacgaccctgtcgcgtggtcatctattatgatggccgggccgccctcgagtgactccgtgcgcgtcttcccnccggctcccactcgtaacgggaaccnccggcccaccctcgaccntcgacgcgacgggtcggacgggccggggatcgggacggacccgattacgttactcgtcgagtcgtggtagggggactaggtagtagtgatcgacgttcccggtgttacgtcgggcgggacggaaccaagcgtcggacccgtcgtcgggccgcggcccgaagggcctccggcccccgtggttcctaaccgttccgttcccgg

SEQ ID NO: 438210 - DNA, 657 bp, Homo sapiens
  misc_feature: GZ8MTXP01D593V.44.36.D03.1.454.CMB.2.raw
  modified_base (275)..(275): a, c, t, g, unknown or other
  modified_base (289)..(289): a, c, t, g, unknown or other
  modified_base (413)..(413): a, c, t, g, unknown or other
  modified_base (468)..(468): a, c, t, g, unknown or other
  modified_base (585)..(585): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtggaggtccgggggagtacgttggtccagccgtggacggtccctgagactctcctgtgtcgctntgatcacatcagtnaccatatagtggacgtcgggtcccgccgaggcctccggaagggggaacgggggctggggagttggcgttcgggacccgtacgaaaaggttaaaaaacgaaggttcgaccctaaagtcttttaanacaacgaggacgtaccgccgcgtctagtagaaacgccaagtacttccaacccctntacgaaagagtatacgaacttacgaaaggtaaccttctaatttgaactttccgagacgtaaattcgaaaccttaaaccgaacggaaaaaacccgggaaggtaaccgaaaccggggtnttaagttagtttaatttagttgttggtttaagttagtttaatagtaccgttaaggtaaccttcggtaacccg

SEQ ID NO: 438211 - DNA, 584 bp, Homo sapiens
  misc_feature: GZ8MTXP01AKHFM.44.36.D03.1.454.CMB.2.raw
  modified_base (219)..(219): a, c, t, g, unknown or other
  modified_base (377)..(377): a, c, t, g, unknown or other
  modified_base (423)..(423): a, c, t, g, unknown or other
  modified_base (430)..(430): a, c, t, g, unknown or other
  modified_base (449)..(449): a, c, t, g, unknown or other
  modified_base (498)..(498): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttagttatttacaaggtgtcagagtgaagtgcagttggtggagtccggggganacgttggtccagcctgggagggtccctgagactctcctgtgtcgcctctggatcaccatcagtgaccactatatggactgggtccgccaggcctccgaggggaagggctgggagtggcttggccgaccaagtaaaacaagttcgaccaagtctttaanacacgagacgtcgcgtcgtctagacgaacgcagtacttccaccctnacaaganatacgtactacaagtactntattgtattcgagactaatacgtaaacctaaaccgaaggaaaacccggnggaaccgacgggtattaagttagttaagtttgtttggttgtttaagttagtttaactagtcggttaacggttaacgttcgtaaccg

SEQ ID NO: 438212 - DNA, 568 bp, Homo sapiens
  misc_feature: GZ8MTXP01AP5N1.44.36.D03.1.454.CMB.2.raw
  modified_base (539)..(539): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctaccaaaaggcaggtgtctttagtatgaccaacatggaccctgcggacaccaggcacatattaactgtgcgacgggtaatggacgggaaagaaacagctggttctgtattataagtacttaccatctggtacgtcgtaggggacgaaacggggggaccacgggttccaccggttactccctcagtccttcccaaccaacgggcccagtcccggtccgttcccctggccgcccctgccttccgaggaacnccaaccgtcgcgggggcaacgcgcccggg

SEQ ID NO: 438213 - DNA, 580 bp, Homo sapiens
  misc_feature: GZ8MTXP01A61SO.44.36.D03.1.454.CMB.2.raw
  modified_base (222)..(222): a, c, t, g, unknown or other
  modified_base (267)..(267): a, c, t, g, unknown or other
  modified_base (276)..(276): a, c, t, g, unknown or other
  modified_base (303)..(303): a, c, t, g, unknown or other
  modified_base (388)..(388): a, c, t, g, unknown or other
  modified_base (471)..(471): a, c, t, g, unknown or other
  modified_base (509)..(509): a, c, t, g, unknown or other
  modified_base (522)..(522): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggagggtccctgagactctctgtgtcgcctntggatcacntcagtgaccatatatggactgggtccnccaggctcgagggagggctgggagtggcttggccgacaaggtaaaaacagttcgacccaaagctttaagcaagagagtacgccgngtactgtagaaagccctagaccttcaaccccttgacaaagagatggaaccttcaaaggggtaacttcgaattggaatttccgngaccgaaatcggtaaacctaaacccgtgaaaaacccgnggaccaacggggnaagttgtaattagttgttagtttgtgttttaaccattcgaggtaaccttggtaacccg

SEQ ID NO: 438214 - DNA, 779 bp, Homo sapiens
  misc_feature: GZ8MTXP01BXY8Z.44.36.D03.1.454.CMB.2.raw
  modified_base (234)..(234): a, c, t, g, unknown or other
  modified_base (271)..(271): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccatgtgaggtgcggctggtggagtcgtgggggagcgttggtacgngggcggggggtccctgagactctcctgtgcagcctcnggattcatcttcagtgactatgcctatgaacgtcggggtcccgccgaggccctaccggaagggggaacgggggtcgtggggaggtttcggggttttacccaagtttagttaggtttaaattgtttacggcgttgggaagtaaccttaaccccacccttaaccgtacgcaacgtaccttcgtggtacgggaacgggggtccctaagtttacccaacccgttaaatttccccggaaaggggaaacctaaacgttaccggaaccccgtaaaagggggtaaacccctttacggtaaacccttagggtttaaactcccggttaaaggggtaaaaccttacgggaaaaccgtaacggtccccggttaagggaaacggggtaaacgggaaaccgggaacgggggaaccgttaacccgggggtcttacggttacccgtttaccgtttacgttaacgggtttaccgaagggtaacggtaccggttcccgggggtaaccctttaacggtttccggggg

SEQ ID NO: 438215 - DNA, 606 bp, Homo sapiens
  misc_feature: GZ8MTXP01DXIO5.44.36.D03.1.454.CMB.2.raw
  modified_base (390)..(390): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccagccgtgggagggtccctgagactctcctgtgtcgcctctggatcacatcagtgaccactatatggactcgggtccgccgaggctccgaggggaggggctgggagtggcttgggcccgacaaaggtaaaaacaagttcgacccaagtctttaancaacagacgtaccgccgcgtctgtagaaacgccagtacttcccaacccttctacgaaagagatgaaccttacaaaggtaaccttntaatttgtattccgtgtaccgtaaaattcgaaacctaaaccgtaggaaaaacccggaaggaaccgacggggacttagttagttatttagttgttagtttgttagtttaatactgaggtaacttgtaacccg

SEQ ID NO: 438216 - DNA, 584 bp, Homo sapiens
  misc_feature: GZ8MTXP01ERD1Z.44.36.D03.1.454.CMB.2.raw
  modified_base (388)..(388): a, c, t, g, unknown or other
  modified_base (443)..(443): a, c, t, g, unknown or other
  modified_base (556)..(556): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagtacgttggtccagccgtgggacggtccctgagactctcctgtgtcgctctggatcaccatcagtgaccactatatggactggtccgccaggctccgaggggagggctgggagtggcttggccgacaaaggtaaaaaacaaggttcgaccctaaagtctttaancaacaggacgtaccgccgcgtctgtagaaagccagacttccaccctctacaaganatagtaacttacgaaaggtaactctaattgaattctgacgaaatcgtaaacctaaaccgtaacgaaaaccggaaggaaccacgggcttaagtgttaattagttgttcgttgtntttaacatcgagtaacgttcgtaacccg

SEQ ID NO: 438217 - DNA, 662 bp, Homo sapiens
  misc_feature: GZ8MTXP01ETJ6O.44.36.D03.1.454.CMB.2.raw
  modified_base (274)..(274): a, c, t, g, unknown or other
  modified_base (310)..(310): a, c, t, g, unknown or other
  modified_base (373)..(373): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttccttgttgttattttacaaggtgtccagagtgaagtgcagttggtggaggtccgggggagacgttggtccagccgtggagggtccctgagactctcctgtgtcgctntggatcacatcagtgaccatatatggactgggtccncaggctcgagggagggctggagtggctggcgacaagtaaaaacagttgccctaagtctttaancaacgagtacgtaccgcgtcgttctagaacgaaacgcctaagtacttacccaacccctgtaacaaaggagtatacgtaaaccttaacgaaacggttaaccttctaagtttcgtaactttcgtacggtaacgtaaacttacggtaaaaccttaaaacccggtaaacgggaaaaacccggaagggtaaccggaacgggtacttaaggttagtttaattttaggtttgggttaggttttaacgtttagttttaacgtagtaccggttaagggttaacctttcgggtaacccg

SEQ ID NO: 438218 - DNA, 651 bp, Homo sapiens
  misc_feature: GZ8MTXP01DAC9C.44.36.D03.1.454.CMB.2.raw
  modified_base (421)..(421): a, c, t, g, unknown or other
  modified_base (429)..(429): a, c, t, g, unknown or other
  modified_base (482)..(482): a, c, t, g, unknown or other
  modified_base (519)..(519): a, c, t, g, unknown or other
  modified_base (575)..(575): a, c, t, g, unknown or other
  modified_base (616)..(616): a, c, t, g, unknown or other
  modified_base (625)..(625): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtccagagtgaagtgctagttgggtggaggtccgggggagtacgttggtccagccgtggacgggtccctgagctctcctgtcgtcgctgtgactcaccatcagtgacccatatagtggacgtcgggtccgccgaggtccgtaccggaagggggaacggggtcgtgggtagtcggtcgttcgggaccgaacgaaaaggtaaaaaacgaagttcgaccctaaagtacttttaanaccgaaanaggacgtaccgccgtctacgtagtaagaaacgccagtaccttccaaccccttnaacaaaggatatacgtaaaccttacgaaaggtacctntaatttgaacttcgtagaccgtaaatcgtaaacctaaacccgtaagaaaacccggngaaccgaggacttaagttagttaatttagttgttaggtttnttgtttaanacgtcgaaggtaaccttcggtaaccg

SEQ ID NO: 438219 - DNA, 661 bp, Homo sapiens
  misc_feature: GZ8MTXP01DYE54.44.36.D03.1.454.CMB.2.raw
  modified_base (414)..(414): a, c, t, g, unknown or other
  modified_base (472)..(472): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttcttgttgttattttacaaggtgtccagagtgaagtgctaggttggtggaggtccgggggagtacgttggtccagccgtggacgggtccctgagtactctcctgtgtcgcctcgtggatcacatcagtcgaccactatagtggacgtgggtcccgccgaggcctccggaagggggacggggcgtagggaggtcggcgttacggccgaacaaaggtaaaaaacaaggttcgaccctaaagtactttaanaccaagagacgtaccgcgcgttctagtagaaacgccaagtactttcccaaccccttanaacgaaagatagtacgtaaacttacgaaacggtaacttagtaagttcgtaacttcgagaacgtaaacgtacgtaaacccttaaaccgaaacggaaaaccggaaggaacgacggtattaagttagtttaatttagtttggttacgtttgttagtttaatacgtacgttaacggtaaccgttcggtaaccg

SEQ ID NO: 438220 - DNA, 635 bp, Homo sapiens
  misc_feature: GZ8MTXP01DWX0K.44.36.D03.1.454.CMB.2.raw
  modified_base (323)..(323): a, c, t, g, unknown or other
  modified_base (352)..(352): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccgagggaaggccctggagtggcttgcacacatcttctcgaatgaacgaaaaatcctacagtacatctctgaagagcagtttaaccatctaccaaggacacctacaaaaggcaggtgtctttagatgacaanatgaccctgcgacacaggcacatataacngtgcaacgggtaatggacgggaaaagaaacagtcttggtttactagttaattaattaaagttcctttaaccattcgtaggacgtcgtaggggaccgaaaaggggggacccacggggtaccaacccggttcctcccgtcacggtccttcccaaccgaaacggggccccaagttcccgggttccctttcccccgtcggttcccggtccccctcgggttcccttcccggaacggtaaccgaccgaacccgttccggtcggggggcctaaccgaacgggcccccggg

SEQ ID NO: 438221 - DNA, 571 bp, Homo sapiens
  misc_feature: GZ8MTXP01EJXS7.44.36.D03.1.454.CMB.2.raw
  modified_base (326)..(326): a, c, t, g, unknown or other
  modified_base (384)..(384): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaaatcctacagtacatctctgaagagcagtttaaccatctaccaaaggacacctaccaaaaggcaggtgtctttagatgaccaanatgaccctgcgacaccaggcacatataactgtgcacgggtaatgacgggaaagaaacngcttggttctagttattaataagttacttaacatctaggacgtcgtaggggacaaagggggaccgtacgggtcaccgtctccgtcacgtaccttccaaccgtaacggcccacgtccggtccttcccccgtggcccgcccgtcgccttccgacggaagccaaccgtcgtcggggacaacgcgcccggg

SEQ ID NO: 438222 - DNA, 531 bp, Homo sapiens
  misc_feature: GZ8MTXP01DE7LA.44.36.D03.1.454.CMB.2.raw
  modified_base (271)..(271): a, c, t, g, unknown or other
  modified_base (356)..(356): a, c, t, g, unknown or other
  modified_base (424)..(424): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaaggtgtccactgtgaggtgcggctggtggagtcgtgggggaggcttggtacgaggcggggggggtccctgagactctcctgtgcagcctcnggattcatcttcagtgactatgccatgaactgggtcccgccaggcctcgaggggagggctgggagtgggtttccatatgttaatnttgactaagagactacccactactacggcagactctgtaggaaggccattaccaccaattcgaggtanaatgaccaaggactcactgtatcagaaatagaacagcctaggagaagacgaggacacggctgttcgttacttcgtgttcgaagtagacgttcggggccttcgttggg

SEQ ID NO: 438223 - DNA, 761 bp, Homo sapiens
  misc_feature: GZ8MTXP01CIQXK.44.36.D03.1.454.CMB.2.raw
  modified_base (443)..(443): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttgggtggaggtccgggggagtacgttggtccaggccgtgggacgggtccctggacgtacttctcccgttgtcgtccgtcctcgtggtactcacctatcagtacgacctactatagtggacgtcgggtcccgccgaggccgtaccggagggggaacgggggtctagggggaggtcggcgttcgggaccgaaccgtaaaaggtaaaaaacgaaggttcgacccgtaaagttactttaanactaaacgaggtaacgtacccgccgtcgtctaggtaacgaaacgccaagtacttcccaccctttacgacaaaggagtactacggtaacctttaacgaaacgtaaccttacgttaagttacgttaaactttccgtagtaaaccgttaaacttaccggaaaaccctttaaaccggtaaaacgggaaaaaccccggggtaagggaaacccggaccgggggtacttaaaggtttagtttaagttttaggtttgggtttacggttttaagggtttattttaagttacgtacgggttaaacggtaaccgttcgggtaaccccgg

SEQ ID NO: 438224 - DNA, 527 bp, Homo sapiens
  misc_feature: GZ8MTXP01BWF9U.44.36.D03.1.454.CMB.2.raw
  modified_base (326)..(326): a, c, t, g, unknown or other
  modified_base (348)..(348): a, c, t, g, unknown or other
  modified_base (356)..(356): a, c, t, g, unknown or other
  modified_base (359)..(359): a, c, t, g, unknown or other
  modified_base (455)..(455): a, c, t, g, unknown or other
  modified_base (459)..(459): a, c, t, g, unknown or other
  modified_base (509)..(509): a, c, t, g, unknown or other
  modified_base (511)..(511): a, c, t, g, unknown or other
  modified_base (517)..(517): a, c, t, g, unknown or other
  modified_base (521)..(521): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctgggagtggcttgcacacatcttctcgaatgaacgaaaatcctacagtacatctctgaaagagactagtttaaccatcctaccaaggacacctaccaaaaggcaggtgtcttagatgaccanatcggacctgcgacacaggcanatataacngtncacgggtaatggacgggaaagaacagtcttgttctagtattataagtacttacatctaggacgtcgtggggacaaagggggccacggtccacgtcncctnacgtctccacgacggccagtcgtccttccccgtgccgcctgcttcaggcncncgtcgnggcncgcgcg

SEQ ID NO: 438225 - DNA, 856 bp, Homo sapiens
  misc_feature: GZ8MTXP01CLSP5.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttatttacaaggtgtcagagtgaagtgcagttggtgggaggtccgggggagacgttggtccaggccgtgggacgggtccctggagactctcctgtgtcgcctctgatcacatcagtcgaccactatagtggacgtcgggtcccgccgacggcgtacccggagggggaacgggggtcgtagggggtaggtcgggtccgtttcggggacccgtaaccgtaaaaggttaaaaaaaaaccgtaaaggtttacgaaccccgtaaaaggttacctttttaacacccgtaaacgaaacgggtaaaccggtacccggccccgggtccgttaccgtaggttaacggaaaaaccggtccccgaaaggttaaccctttaccccgaaaccccccgttttactaaacccgtaaaacgggtaaaggaaactttaaccggtaaaccttttaaacccgaaaaaaggggttaaaccctttaaccgttaaattttaccggtaaatttcccgtaggtaacgtaaaacgtacgtaaaacccgttaaaacccgtaaacgggaaaaaaacccgggcgggtaaaccgaaccgggggtacttaaagtttaaggtttaattttaaggttttggttaggtttttaagttaaccggtttttaattaacgttacggttaaaacgggttaaccgttcgggttaaccccggg

SEQ ID NO: 438226 - DNA, 622 bp, Homo sapiens
  misc_feature: GZ8MTXP01BR4JI.44.36.D03.1.454.CMB.2.raw
  modified_base (370)..(370): a, c, t, g, unknown or other
  modified_base (378)..(378): a, c, t, g, unknown or other
  modified_base (417)..(417): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtcccgccaggctccgaggggaagggctggagtggcttggccgacaaagtaaaacaaggttcgaccagctttancaaacagngtacgccgcgtctagtagaaagccagtacttccaccctntacaaaggacgtatagaacttacgaaacgtaacttctaatttgggaatttccgtagaccgtaaattcggaaaccttaaaccgtacggaaaaacccgtgggaaccaacggggctaagttgttaatttagttggttagtttgtttacgtttattacttcgaaggtaacttcgggtacccgacggttaacgggggccccgtaacgggg

SEQ ID NO: 438227 - DNA, 697 bp, Homo sapiens
  misc_feature: GZ8MTXP01ECEXJ.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacatcttctacgaatagaacgaaaatcctaacagtacatctctagaagagactaagtttaaccatacctaccaaaggaccaacccgtaaccaaaagggctagggtacgttactttaagtatacgaacccaacagtcggaccctggaccggacacgacggacacgtaattacttaacgtgtcgacgtaaacgggtaaatcgggaacgggaaaagaaactaggtcgttggtttactaggttaatttaagttaaacgttaccgtttaacctagttcgtaggaccggtggtaacggggaaccgaaaacggggggaccctaccggggtacctaaccggttcctaccctagacgtacccttaacccgaccgaaccgggtccctacgttcccggttcccttcccccgtcggcccgtaccccgtcgttccgcccgagggtccaccgtcccgttccgggcgggggacctaaccggcggtcccggg

SEQ ID NO: 438228 - DNA, 558 bp, Homo sapiens
  misc_feature: GZ8MTXP01A1S46.44.36.D03.1.454.CMB.2.raw
  modified_base (268)..(268): a, c, t, g, unknown or other
  modified_base (306)..(306): a, c, t, g, unknown or other
  modified_base (343)..(343): a, c, t, g, unknown or other
  modified_base (479)..(479): a, c, t, g, unknown or other
  modified_base (493)..(493): a, c, t, g, unknown or other
  modified_base (532)..(532): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcttggtacaggcgggggggtccctgagactctcctgtgcagcctcnggattcatcttcagtgactatgccatgaactgggtccncaggctcgagggaggctggagtggttcatatgtaatnttgctggagactacccacctactacgcagtactcgtggtggaaacgggccctaattcccgaaccctaagttcccgaaggggaaccaagtcgacccaaagggaacttcaactcgtatcgtaggaaatggaacagccnggaagaacgaacgnggacacgggcttgttccttacttccgtgttcgaaggtanacggttccgggtccttaacgtttggg

SEQ ID NO: 438229 - DNA, 648 bp, Homo sapiens
  misc_feature: GZ8MTXP01EER2N.44.36.D03.1.454.CMB.2.raw
  modified_base (217)..(217): a, c, t, g, unknown or other
  modified_base (341)..(341): a, c, t, g, unknown or other
  modified_base (369)..(369): a, c, t, g, unknown or other
  modified_base (415)..(415): a, c, t, g, unknown or other
  modified_base (431)..(431): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccgccaggctccgagggaagggctgggagtggcttggccganaagtaaaaacaagttcgaccagctttancaaacagaagtacgccgcgtctgtagaaagcccagacttcaccctntacaagagatgacttnaaacgtaactctattcggggtaattccgtaggaccgtaaatacggtaacctaaaccgtacggaaaaaaccgtgggaaaccgacgggggctaaagtttgggttaaatttaacgtttgggtttaagtttggtttaacggtttttaattaacgtttccgaaaggggtaaacctttcgggtacccgttacgggtttaacggggggcccgttaaaccggggg

SEQ ID NO: 438230 - DNA, 599 bp, Homo sapiens
  misc_feature: GZ8MTXP01AN4PL.44.36.D03.1.454.CMB.2.raw
  modified_base (330)..(330): a, c, t, g, unknown or other
  modified_base (351)..(351): a, c, t, g, unknown or other
  modified_base (359)..(359): a, c, t, g, unknown or other
  modified_base (566)..(566): a, c, t, g, unknown or other
  modified_base (588)..(588): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccagggaacggccctggagtggcttgcacacatcttctcgaatgaacgaaaatcctacagtacatctctagaagagactagtttaaccatctaccaaggaccacctaccaaaaggcaggtgtcttagtatgaccaanatgacctgcgacaccaggcanatataacngtgcaacgggtaatggacgggaaaagaaacgagtcgtggtttactagttaattataagttacttaacctaatcgtaggtacgtcgtaggggacgaaacggggggacccgtaacggtccacccgttcctcccgtcgacgtccttaccaacccgaacgggcccagtcccggtcccttccccgtcggccgccctcgccttcgacggaacnccaaccgttcggcgggggaccncgccggccggg

SEQ ID NO: 438231 - DNA, 677 bp, Homo sapiens
  misc_feature: GZ8MTXP01DJP7F.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttatttacaaggtgtccagagtgaagtgcagttggtggaggtccgggggagtacttggtccaggccgtgggacgggtccctgacgactctcctgtgtcgcctctggatcacatcagtcgaccatatagtggacgtcgggtcccgccgaaggccgtaccggaagggggaacgggggtcgtagggggagttgggtccgttgggacccgtaacgaaaacggtaaaaaaacgtaaggttcgacccaaagttactttaacgcaacgaaggacgtaccgccgtcgtctagtaggaaactccaagtcttacccaaccctctaacgaaagagaatgaaactttaccaaaggtaaactctaattagtaactttcgagacgtaaaattcgaaaacctaaaccgtacggaaaaaaacccggcggaaacgaaccggggtacaagttaggttaatttaagttgttaggtttaagttagttttaacagtacgttagggtaacccttgggttaacccg

SEQ ID NO: 438232 - DNA, 543 bp, Homo sapiens
  misc_feature: GZ8MTXP01ANZ6U.44.36.D03.1.454.CMB.2.raw
  modified_base (321)..(321): a, c, t, g, unknown or other
  modified_base (410)..(410): a, c, t, g, unknown or other
  modified_base (419)..(419): a, c, t, g, unknown or other
  modified_base (515)..(515): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaagacacctaccaaaaggcaggtggtctttagatgaccaanatgacctgcgacaccaggcacatataactgtgcacgggtaatggacgggaaagaaacagcttggttctagtattataagtcttacatcnggacgtcgnggggtacaaagggggaccacggtcaccgtctccgtcacgcttccaccgaaggcccagtcggtccttccccgtggccgtccctgccgttcgacggcnccgccttcgcggggccaacgcggcccgg

SEQ ID NO: 438233 - DNA, 562 bp, Homo sapiens
  misc_feature: GZ8MTXP01EHKLB.44.36.D03.1.454.CMB.2.raw
  modified_base (280)..(280): a, c, t, g, unknown or other
  modified_base (296)..(296): a, c, t, g, unknown or other
  modified_base (334)..(334): a, c, t, g, unknown or other
  modified_base (359)..(359): a, c, t, g, unknown or other
  modified_base (554)..(554): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattaccgtgtgggggcgacgccgttggaggtaaagtgtacagtgtacagcagagccaggccagacccctgngctggtcatctattangatcgcgggccgcctcagtgactcctgcgcgcttcccnccggctccaactcgtacgggaaccnccggcccacccgtcgaccatcacgcgagggtcgacgggccggggatcggacggccgactattaccgtgtcgagcgtggtgggggactaggtagtagtcgagtctacgtcccgtggtattcgtggcgggaagggccaaggccgttcggaccgttccgttgggttcacggcccgaggcctccgccccgttacggtcnccgttccg

SEQ ID NO: 438234 - DNA, 598 bp, Homo sapiens
  misc_feature: GZ8MTXP01DIR2D.44.36.D03.1.454.CMB.2.raw
  modified_base (448)..(448): a, c, t, g, unknown or other
  modified_base (458)..(458): a, c, t, g, unknown or other
  modified_base (577)..(577): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgttggtccagccgtggagggtccctgagactctcctgtgtcgctctggatcacatcagtgaccactatatggacgtggtccgccaggctccgaggggaacggggctgggagtggcgttgggcccgacgaaaggtaaaaaacaaaggtttcgacccaaagtctttaagtcaaccaggacgtacgccgtcggtctgtagaaacgccagtacttccaacccctntacaaagganatgtaacttcaaaggtaacttctaatttcgatttcgtgacgtaaatcgaaacctaaaccgtacgaaaacccggaagaacgacgggcaagttgtaatttagttgttgtttgtagtttaanatcgaggtaacttgtaacccg

SEQ ID NO: 438235 - DNA, 579 bp, Homo sapiens
  misc_feature: GZ8MTXP01EC5E4.44.36.D03.1.454.CMB.2.raw
  modified_base (299)..(299): a, c, t, g, unknown or other
  modified_base (354)..(354): a, c, t, g, unknown or other
  modified_base (365)..(365): a, c, t, g, unknown or other
  modified_base (373)..(373): a, c, t, g, unknown or other
  modified_base (412)..(412): a, c, t, g, unknown or other
  modified_base (486)..(486): a, c, t, g, unknown or other
  modified_base (495)..(495): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttcctgttgttatttacaaggtgtccagagtgaagtgcagttggtggagtccgggggagacttggtccagccgtggagggtccctgagctctcctgtgtcgcctctggattcaccatcagtgaccatatatggactgggtccnccaggcctcgaggggagggctgggagtggcttgggccacaagtaaaacaagttcnccagtctttancaactagngtacgccgcgtctgtagaaacgccagtacttccaccctnacgaagatactcgactacaaagtactactattggtacttgtacgacgtaatacgaacctaaacgaacgaaacgngacgacggntaagttgttattagtttgtgtttagttacgtttattacgtaacgtaagtaacctcgtaccgacgggtcgggaaccgtaaccggg

SEQ ID NO: 438236 - DNA, 594 bp, Homo sapiens
  misc_feature: GZ8MTXP01EIO74.44.36.D03.1.454.CMB.2.raw
  modified_base (318)..(318): a, c, t, g, unknown or other
  modified_base (397)..(397): a, c, t, g, unknown or other
  modified_base (456)..(456): a, c, t, g, unknown or other
  modified_base (499)..(499): a, c, t, g, unknown or other
  modified_base (531)..(531): a, c, t, g, unknown or other
  modified_base (573)..(573): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccaggccgtgggacgggtccctgagactctcctgtcgtcgcctctggatcaccatcagtgaccactatagtggactgggtcccncgaggctccgaggggaggggctgggagtggcgttggccgacaaaggtaaaaaacaaggttcgacctaaagtcctttaanccaacgagacgtaccgccgcgttactagtacgaaaacgccaagtacttcccaacccctntacaaagagatgaacttacaaaggtaacttcatttgatttcgngacgtaaatgaacctaaactaggaaaacccgnggaacacgggacagtgttaattgttgttgtttgtagtttaanatcgaggtaacttgtaacccg

SEQ ID NO: 438237 - DNA, 588 bp, Homo sapiens
  misc_feature: GZ8MTXP01COTMU.44.36.D03.1.454.CMB.2.raw
  modified_base (482)..(482): a, c, t, g, unknown or other
  modified_base (571)..(571): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccgggggagacttggtccagccgtgggagggtccctgagactctcctgtgtcgcctcgtggatcaccatcagtgaccactatatggactggtccgcaggctccgaggggaggggctgggagtggcttgggccgacaaaggtaaaaaacaaggttcgaccctaagtccttttaagcaaacgagagtaccgccgtcgtctgtagaaagccaagacttccaccctctacaaagagtatgacttacaaacggtaactctaattgatttcgngacgtaaatcgtaaacctaaaccgtagaaaacccgaaggaacacggggacagttagtatttagttggttagtttcgtagtttaatagtnaggtaacttgtaacccg

SEQ ID NO: 438238 - DNA, 652 bp, Homo sapiens
  misc_feature: GZ8MTXP01ECUU4.44.36.D03.1.454.CMB.2.raw
  modified_base (272)..(272): a, c, t, g, unknown or other
  modified_base (383)..(383): a, c, t, g, unknown or other
  modified_base (499)..(499): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacttggtccagccgtgggagggtccctgagactctcctgtgtcgctntggatcacatcagtgaccatatatggactggtccgccaggctccgagggggagggctgggagtggcttggaccgacaaagtaaaaacaagttcgaccctaaagtctttaanccaacgaggacgtaccgccggtgttctaggtagaaacgcccagtactttccaaccccgttctacgaaagagatacgaactttaccaaagggtaacttctaagtttcgaatttccgngtacggtaaaacttcggtaaacccttaaaacccgtaaggaaaaaccccggaagggaaacccgaaccgggggtacttaagttaggtttaatttaagtttggttggttttaagttagttttaactactcggaagggtaaaccttgggtaacccgg

SEQ ID NO: 438239 - DNA, 640 bp, Homo sapiens
  misc_feature: GZ8MTXP01C4RZU.44.36.D03.1.454.CMB.2.raw
  modified_base (221)..(221): a, c, t, g, unknown or other
  modified_base (303)..(303): a, c, t, g, unknown or other
  modified_base (445)..(445): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcagttggtggagtccgggganacttggcagcctggagggtccctgagactctcctgtgtcgctctggatcaccatcagtgaccactatatggactggggtccnccaggcctaccgagggggaagggggctgggagtggcttgggcccagaaagtaaaaaacagttcgaccctaaagtctttaagcaacgaagacgtacgccgtcgtctgtagaacgcagacttacccacccttctacaaaggaanaatacgtaactaacgaaacgtaacttacgtaagttacgtaacttacgtacgtaacgtaaacgtacgtaaaacccgtaaaccgtaaaccggaaaaccggaacgggaaaccgacgggtaacttaagttaagttaagtttagtttcgttagtttaagtttagtttaactagtacgttaacggtaacgttcggtaaccg

SEQ ID NO: 438240 - DNA, 623 bp, Homo sapiens
  misc_feature: GZ8MTXP01B65HG.44.36.D03.1.454.CMB.2.raw
  modified_base (308)..(308): a, c, t, g, unknown or other
  modified_base (388)..(388): a, c, t, g, unknown or other
  modified_base (439)..(439): a, c, t, g, unknown or other
  modified_base (446)..(446): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagtacttggtccagcctggagggtccctgagactctcctgtgtcgctcgtggatcaccatcagtgaccatatatggactcgggtccncgaggctccggagggggaagggctgggagtggcttcgggccgacgaaagtaaaaacaaggttcgccctaaagtctttaancaacgagacgtacgccgcgtctgtagaaacgccagactttccaaccccttnacgaagntatacgtaactacgaaagtaccttatattacgtattcgagtacgtaaatacgtaaaccctaaacgtaacggaaaaccggaacggaaccgacgggtacttaaagtttagttaatttaggtttgttaggtttaagttagtttaatacgtacggttaacggtaaccgttccggtaacccg

SEQ ID NO: 438241 - DNA, 630 bp, Homo sapiens
  misc_feature: GZ8MTXP01DN8AU.44.36.D03.1.454.CMB.2.raw
  modified_base (247)..(247): a, c, t, g, unknown or other
  modified_base (511)..(511): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacagtggganatatactgtctctgtatacaaacaacataccaaggaccaaaaccgacccccaaaactctaattacgtttttgacgttccaagtcggacgccggtccgtctagggttctttacgtaagtcgtctttccttcgtcggtcctacccgtaaagttccgtacgggaccccacgtaccccgggtcccttcccgtgtccgacttccgtccgtcggggtcctcccgggcgtaggacggacggagggtccttggggtaacttaacgtttccgnggtccgtctcttaattacctaactcgttagtacgtcgttggggtcgttcgggacgggttaggactcgaccgttcgacccgtctaggtccgacgacccgacgtcccgttcccgtcccccg

SEQ ID NO: 438242 - DNA, 652 bp, Homo sapiens
  misc_feature: GZ8MTXP01DV30W.44.36.D03.1.454.CMB.2.raw
  modified_base (371)..(371): a, c, t, g, unknown or other
  modified_base (419)..(419): a, c, t, g, unknown or other
  modified_base (504)..(504): a, c, t, g, unknown or other
tcagacagtatatacacgaccggtgctcgatttagctgcgtcacgatctctcttggggagagtggagccccagccccagaattcccaggtgttttcatttggtgatcagcactgaacacagaggactcaccatggagttcgggctgagctgggttttccttgttgttattttacaaggtgtccagagtgaagtgcaggttggtggagtccgggggagacttggtccagcctggagggtccctgagactctcctgtgtcgcctctggattcaccatcagtgaccatatatggactgggtccgccaggctccgagggggaagggctgggagtgggcttggccgacaagtaaaacaagttcgaccagtctttancaacagaacgtacgccgcgtctgtagaaagcccagtacttccaccctntacaaagagatgacttacaaagaactcaatttggaactttcgtagaccgaaattcgaaccttaaaccgtaaggaaaaaacccggnggaacccgaacgggggctaaagtttaggttaaattttaagttttggttacggttttggtttaggtttttaaacttaagtccgtaaaaggggtaaccctttcgggtaccccttaacgggtttcgggggggaaccccctaaaccgggggg

SEQ ID NO: 438243 - DNA, 615 bp, Homo sapiens
  misc_feature: GZ8MTXP01AU3M5.44.36.D03.1.454.CMB.2.raw
  modified_base (278)..(278): a, c, t, g, unknown or other
  modified_base (376)..(376): a, c, t, g, unknown or other
  modified_base (388)..(388): a, c, t, g, unknown or other
  modified_base (404)..(404): a, c, t, g, unknown or other
  modified_base (436)..(436): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtgggaggtccgggggagtacgttggtccagccgtgggagggtccctgagactctcctgtgtcgcctntggatcaccatcagtgaccactatagtggacgtgggtcccgctggcctccgaggggaagggctggagtggcttggccgcaaaggtaaaaacaagttcncaagtctttaancagagacgtacgccgngtctgtagaaacgccaagtacttcgacccctntacgaagagatcgaacttacaaagggtactctaagtttnaatttccagaccgaaattcgaaacccttaaacgtacggaaaaacccggtggaaacccgacggggacttaagttggttaatttaggtttgttaggtttggttatttaacgtagtcgttaacgggtaacttgggtaaccccg

SEQ ID NO: 438244 - DNA, 715 bp, Homo sapiens
  misc_feature: GZ8MTXP01EHE6Z.44.36.D03.1.454.CMB.2.raw
  modified_base (273)..(273): a, c, t, g, unknown or other
  modified_base (298)..(298): a, c, t, g, unknown or other
  modified_base (380)..(380): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacttggtccagccgtggagggtccctgagactctcctgtgtcgcctntggatcaccatcagtgaccatatanggactggtccgcgaggctccgagggggagggctgggagtggctggccgacaaagtaaaaacaagttcacccaagtctttaancaacgagacgtaccgccgcgttcgtagtagaaacgccctaagtacttccaaccccttactaccaaaggacgtaactacgtaacctttacgaaaacggggtaaccttcgtaaattttcgtaaacttttcccgaaggtacccgtaaaagttccgggtaaaacccttaaaacccgtaaccgggaaaaaaaccccgggaagggtaaacccggaacgggggtaaccttaaaggtttacggtttaaatttttaaaggtttggtttagggtttttaacggtttagggttttttaaataacgtttaccggaaagggttaaaccgtttcgggttaacccccggg

SEQ ID NO: 438245 - DNA, 659 bp, Homo sapiens
  misc_feature: GZ8MTXP01ES42Y.44.36.D03.1.454.CMB.2.raw
  modified_base (223)..(223): a, c, t, g, unknown or other
  modified_base (258)..(258): a, c, t, g, unknown or other
  modified_base (273)..(273): a, c, t, g, unknown or other
  modified_base (279)..(279): a, c, t, g, unknown or other
  modified_base (281)..(281): a, c, t, g, unknown or other
  modified_base (330)..(330): a, c, t, g, unknown or other
tcagacagtatatacacgaccggtgctcgatttagctgcgtcacgatctctcttcgggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagacttccntctgtgtcgctctgntcacancnacgtacgacctactatagtggtacgtcggtccggccgacgcgtaccggncgaagggggaaggggtcgtggtagggtacggtcgttcgggacccgacgtaaacgtaaaaaacgtaaaggttacgtaccgaacgtactttactacaacgaagtaacggtaaccgacccggtacgtacgtaggtaaggtaaacgtacgaacgtacttacccgtaccctacctaacgaaacgaagtaagtacgtaacttaactaaacgtaaactactattagtaacttacgttacgtaacgttaaacgtaacgtaaaccgttaaaccgttaaacggaaaaccgggaaacggaacggaaccgggtacgtagttagtttaagtttaagtttaag

SEQ ID NO: 438246 - DNA, 524 bp, Homo sapiens
  misc_feature: GZ8MTXP01C9CVB.44.36.D03.1.454.CMB.2.raw
  modified_base (310)..(310): a, c, t, g, unknown or other
  modified_base (355)..(355): a, c, t, g, unknown or other
  modified_base (478)..(478): a, c, t, g, unknown or other
  modified_base (503)..(503): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaaggtgtccactgtggggtgcggctgggtggagtcgtgggggaggcttgggtacaggcggggggggtccctggagactctcctgtgcagcctctggattcatcttcagtgactatgccatgactgggtccncaggctccgagggagggctggagtggttcatatgttatatgctgngactaccacctactacgcagactctgtagagggccattccaactacttccagggacaatcgaccaagactcacgtagtatcgtagaaatgaaactcgcctaggagagaacggaggacacgggntcggtcttacgttcgttgttcgagngagtcgggctaagttgtaacg

SEQ ID NO: 438247 - DNA, 607 bp, Homo sapiens
  misc_feature: GZ8MTXP01DGCQ8.44.36.D03.1.454.CMB.2.raw
  modified_base (308)..(308): a, c, t, g, unknown or other
  modified_base (378)..(378): a, c, t, g, unknown or other
  modified_base (439)..(439): a, c, t, g, unknown or other
  modified_base (486)..(486): a, c, t, g, unknown or other
  modified_base (518)..(518): a, c, t, g, unknown or other
  modified_base (527)..(527): a, c, t, g, unknown or other
  modified_base (558)..(558): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcaggttggtgggaggtccgggggagacgttggtccagccgtgggagggtccctgagactctcctgtgtcgcctctggattcacatcagtcgaccatatagtggacgtgggtccnccagggcctccgaggggaagggctgggagtggctggccacaaagtaaaacaagttcgacctagtctttancaaacgagaacggtaccgccgtacgttctagtaggaaacgcccaagtacttccaacccctntacaaagagtatcgaacttacaaagtaactcaattggactttcgtanacgaaatcgaaccttaaccgtaagaaaaccgngacacgggnaattgttatttattgttgttgttgttttaanagttcgaaagggtaacttggaccccttagggtcggggcccgtaacgggg

SEQ ID NO: 438248 - DNA, 616 bp, Homo sapiens
  misc_feature: GZ8MTXP01CC13V.44.36.D03.1.454.CMB.2.raw
  modified_base (205)..(205): a, c, t, g, unknown or other
  modified_base (219)..(219): a, c, t, g, unknown or other
  modified_base (296)..(296): a, c, t, g, unknown or other
  modified_base (368)..(368): a, c, t, g, unknown or other
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaaggtgtcagagtgaagtgcgagttggnggagtccggggganacttggccagcctggaggtccctgagctctcctgtgtcgctctggatcacatcagtgaccatatatggactggtccncgaggctaccggaggggagggctgggagtggcttggccacaagtaaaaacagttcgacctaagtcctttaancaacgagacgtccgcgtctcgtagtacgaaacgctaagtacttacccaccctntaacgaagactagtacgtactaacgtaaacggtaacgtactagttagtacgttacgtacgtaacgtaacgtaacgtaaaccgtaaaccgtaaacggaaaccggaacggaacggaacggtacgttagttagttagtttagtttgttagtttaagtttagtttaagttacgtacgttacgtaacgttaacgtaaccg

SEQ ID NO: 438249 - DNA, 627 bp, Homo sapiens
  misc_feature: GZ8MTXP01DMR66.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggagggtccctgagactctcctgtgtcgcctctggatcaccatcagtgaccactatatggactgggtcccgccgaggcctccgagggggaagggggctgggagtggcttgggccgacaaaggtaaaaaacaaggttcgacccaaagtcttttaagcaacgaaggacgtaccgcccgtcgtctagtagaaaacgcccaagtacttcccaaccccttctacaaaggagactagtaacctttacgaaaggtaaccttctaatttgactttccgtgacgtaaatcgtaaacctaaaccgtaaggaaaaacccggaaggaaccgacggggcttaagttgttaatttagttggttagtttgttacgtttaatatcgaaggtaacttcgtaaccg

SEQ ID NO: 438250 - DNA, 594 bp, Homo sapiens
  misc_feature: GZ8MTXP01CWS48.44.36.D03.1.454.CMB.2.raw
  modified_base (217)..(217): a, c, t, g, unknown or other
  modified_base (302)..(302): a, c, t, g, unknown or other
  modified_base (373)..(373): a, c, t, g, unknown or other
  modified_base (505)..(505): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccnccaggctccgaggggaagggctgggagtggcttgggccgacaagtaaaaacaaggttcgaccagctttaancaaacagcgtacgccgacgtctgtagaaagcccagtattccaccctctacaaagagatgaacttcaaagtaactcaatttggaatttctagaccgaaattcgaaaccttaaacccgtaggaaaaaaccccgngggaaccaacggggactaagtggttaatttagttggttagttgttagtttattatcgaaggtaacctgtccagtcggggcctaacgggg

SEQ ID NO: 438251 - DNA, 644 bp, Homo sapiens
  misc_feature: GZ8MTXP01BF81M.44.36.D03.1.454.CMB.2.raw
  modified_base (278)..(278): a, c, t, g, unknown or other
  modified_base (408)..(408): a, c, t, g, unknown or other
  modified_base (473)..(473): a, c, t, g, unknown or other
  modified_base (512)..(512): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtcagagtgaagtgcaggttggtgggaggtccgggggagtacgttggtccagccgtggacggtccctgacgtctctcctgtcgtcgcctntggatcacatcagtcgaccatatagtggacgtcgggtcccgcgaggcctaccggagggggaagggcgtgggagttggcgttcggacccgacaaaggtaaaaaacaaggttcgaccctaaagtactttaanactaacgagaacgtaccgccgtcgttctaggtacgaaacgcccaagtacctttccaacccccttnaacgaagacgtactacgtaaccttaacgaaacgtacttntaagttacgtacttcgagaactaaacgtacgtaaacctaaacgaacggaaaaccggcggaacgacggacttagttagttaatttgttgttagtttgttatttaatacgtacgttaagtaacgttcgtaaccg

SEQ ID NO: 438252 - DNA, 584 bp, Homo sapiens
  misc_feature: GZ8MTXP01C3TQL.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggccctggataagggttgatggatggtagggagctactctggcaatggtaacacaggctatgcacagaagttcagggcagagtcacatcgacaggacacgtcacgagcacacgcctacagtggagccgttagagcagtcgagacgactcgtagaggacagtaacgatgtagtactagtgtgcgagaccggtagaggacaagacgaaagtaaaagtaagtttacgttttagacgttacggtacgggaccgaaacgggtacccgtgggtaccgacccgtcctaccgtcaccgtcccaccgaaccgacgtccctacgtccgttccctcccgtcggccctaccccgttccgtaccgaacgacgttccgttacccgtcggtccggggcctacggaccggttcccggtccggttcgggtcccg

SEQ ID NO: 438253 - DNA, 584 bp, Homo sapiens
  misc_feature: GZ8MTXP01BA9UD.44.36.D03.1.454.CMB.2.raw
  modified_base (314)..(314): a, c, t, g, unknown or other
  modified_base (354)..(354): a, c, t, g, unknown or other
  modified_base (379)..(379): a, c, t, g, unknown or other
  modified_base (425)..(425): a, c, t, g, unknown or other
  modified_base (442)..(442): a, c, t, g, unknown or other
  modified_base (500)..(500): a, c, t, g, unknown or other
  modified_base (545)..(545): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagtacgttgggtccaggccgtgggacgggtccctgagactctcctgtgtcgcctctggattcacctatcagtcgaccactatagtggactgggtccnccaggcctccgaggggagggctgggagtggcttgggccanaagtaaaacagttcacagtctttancaacagcgtacgccgcgtctgtagaaacgccagtacttccaccctntacaagagatgacttanaaagactcattggatttcgagacgtaaatcggaaaccttaaccgaaggaaaacccggngaaccgacgggataattggttaattagttgtgtttgttagtttanactcgaaggtaactggtcccaggtcggggcctaacgggg

SEQ ID NO: 438254 - DNA, 597 bp, Homo sapiens
  misc_feature: GZ8MTXP01AT6MI.44.36.D03.1.454.CMB.2.raw
  modified_base (308)..(308): a, c, t, g, unknown or other
  modified_base (385)..(385): a, c, t, g, unknown or other
  modified_base (408)..(408): a, c, t, g, unknown or other
  modified_base (465)..(465): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgttatttacaaggtgtcagagtgaagtgcagttggtggaggtccgggggagacgttggtccagccgtgggacgggtccctgacgactctcctgtgtcgcctctggatcaccatcagtgaccatatatggactggggtccncgaggctaccgagggggaaggggctggggagtggcttggccgacaaaggtaaaaaacagttgccctaagtctttaancaacgagtacgtaccgcgtcgtntagtagaacgcagtactacccacctcacgaagagatacgtaacttacgaaagtactntagttcgtattcgacgtacgtaactacgtaaacctaaaccgtaacggaaaccgaaggaacgacggtattagttagttatttgttgttagttgttagtttaacgtgtacgttaacggtaacgttcggtaaccg

SEQ ID NO: 438255 - DNA, 626 bp, Homo sapiens
  misc_feature: GZ8MTXP01CXXA4.44.36.D03.1.454.CMB.2.raw
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattacctggtgggggcgacgccgttggaggtaaagtgtacagtggaccagcagaagccaggccagacccctgtgctggtcatctttcaggataatagcggccctcgagggatccctgagcgcttctctcggctcaactcgtggaaacacgggccactctgaccatcacgccgccgacccagccctcgtcggatggaggctagacttaagttacctagttaccgaggggtacggttagggggaaacgtggtaccttaaaggttggggttggtttaccggggacgggtaacggggaacccaaggtcgtaacggtaacccggtttcgtccgggttcgacggccccgaaacgggttcccttaccggtccccccgtacgggtccctaccgtcccgttcccgttcccccggccccgtttcccg

SEQ ID NO: 438256 - DNA, 574 bp, Homo sapiens
  misc_feature: GZ8MTXP01DRM03.44.36.D03.1.454.CMB.2.raw
  modified_base (271)..(271): a, c, t, g, unknown or other
  modified_base (312)..(312): a, c, t, g, unknown or other
  modified_base (345)..(345): a, c, t, g, unknown or other
  modified_base (493)..(493): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccatgtgaggtgcggctggtggagtcgtgggggagcttggtacgagggcgggggggtccctggagactctcctgtgcagcctcnggatcatcttcagtgactatgccatgactggtccgcaggcncgagggagggctggagtggttcatatgttaatntgctgatactacccactacacgcagtactcgtggtaggaacgggtcctaacttaccaaccttaaatcccgaagggtaaaccaagtcgaacccaaagggtaaccctctaacttagtaactcgtaggtaaaatacgaaacctagtaccgngaaacgggaacgaccggaggaccgacggtctcgttacttcgttcgtggttacgaagtagacgttcgggtccttggtttcgg

SEQ ID NO: 438257 - DNA, 594 bp, Homo sapiens
  misc_feature: GZ8MTXP01BW46K.44.36.D03.1.454.CMB.2.raw
  modified_base (390)..(390): a, c, t, g, unknown or other
  modified_base (447)..(447): a, c, t, g, unknown or other
  modified_base (466)..(466): a, c, t, g, unknown or other
  modified_base (518)..(518): a, c, t, g, unknown or other
  modified_base (527)..(527): a, c, t, g, unknown or other
  modified_base (553)..(553): a, c, t, g, unknown or other
  modified_base (577)..(577): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttatttacaaggtgtccagagtgaagtgcaggttggtggaggtccgggggagacgttggtccagccgtgggagggtccctgagactctcctgtgtcgcctctggacttcacatcagtcgaccactatagtcggacgtcgggtcccgccaggcctaccggagggggaagggggctgggagtgggcgtggccgacaaagtaaaaacagttcgcctagtctttaancaaacagaacgtaccgcccgtcgtctagtacgaaacgcccagtacttccaccccttnacaagagtatacgacttanaaagaactctaattggatttcgagacgtaatcgaacctaacgtaagaaacgnggacacggnaatgttattgttgtgttcgttagttnttagtaacgagtaactcgtaccgnggtcggggcctaacggg

SEQ ID NO: 438258 - DNA, 761 bp, Homo sapiens
  misc_feature: GZ8MTXP01BABUF.44.36.D03.1.454.CMB.2.raw
  modified_base (334)..(334): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctaacagtacatctctagaagagctaagtttaaccatcctaccaaggacacctaccgaaaggcaggtggtactttagtatgaccaanagtcggaccctggcggacaccgaggacacatacttaactgtcgacgtaaacggggtaatcgggaacggggaaaagaaacgtagtacgtttagggtttacttaggttaatttaacgttaacgttaccctttaacctagttaccgttacggggtaaccgttcgggtacggggggtaacccgaaaacgggggggtaccccgtaaccggggttacccgaacccggttcctccccgtaccgtaccggtaccctttaccccgtaaccccggaaacccgggggtcccctaacggttccccggggttcccctttcccccccggtcggggttcccccgtccccgtccggttcccgttccccgaagggggaaccccgtccccgtaacccgggttccggggaccgggggaccctaaccgggaacccggggtccccggg

SEQ ID NO: 438259 - DNA, 605 bp, Homo sapiens
  misc_feature: GZ8MTXP01B4BRC.44.36.D03.1.454.CMB.2.raw
  modified_base (217)..(217): a, c, t, g, unknown or other
  modified_base (263)..(263): a, c, t, g, unknown or other
  modified_base (302)..(302): a, c, t, g, unknown or other
  modified_base (371)..(371): a, c, t, g, unknown or other
  modified_base (379)..(379): a, c, t, g, unknown or other
  modified_base (388)..(388): a, c, t, g, unknown or other
  modified_base (417)..(417): a, c, t, g, unknown or other
  modified_base (506)..(506): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcaggttggtggagtccggggganacttggtccagcctggagggtccctgagactctcctgtgtcgcctntggattcaccatcagtgaccactatatggactgggtccnccaggcctcgaggggaagggctgggagtggcttgggccacaagtaaaaacaagttcgaccagtctttancaaacagngtacgccgngtctgtagaaagcccagacttccaccctntaccaaagacgatcgacttacaaagtaacctatagttcggaatttctagacgtaaatcgtaaaccctaaaccgtaacggaaaaacccgnggaaaccgaccggggctaagttaggttaatttagttgttagtttgttagtttacttataacgaggtaacttcggcccacggtcgggggcctaaccgggg

SEQ ID NO: 438260 - DNA, 608 bp, Homo sapiens
  misc_feature: GZ8MTXP01EGQOH.44.36.D03.1.454.CMB.2.raw
  modified_base (279)..(279): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgaggttgggtggaggtccgggggatacgttggtccagccgtgggacggtccctgacgctctccgtgtgtcgcctntggatcaccatcagtcgaccatatagtggacgtggcccgccgaggccgtaccggaggggaggggctgggagtggcttgggaccacaaaggtaaaaacaggttcaccctaagtactttgacaacgaagtacgtaccgccgtcgtatgtagaaacgtcgaagtacttacccacctctaacgaagagactgtaacttacgaaacggtactactagttagtattcgagtaccgaaagtcgtaaactaaaccgtaagaaacccgtaaggacgacggtattagtagttatttagttgttgttaagttattgtatcggagtaacgttcggtaaccg

SEQ ID NO: 438261 - DNA, 769 bp, Homo sapiens
  misc_feature: GZ8MTXP01DMQ7L.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatagaacgaaaatcctacagtacatctctagaagagctagtttaaccatctaccaagacacctacaaaggcaggtgtactttagtatagaccaacacgtcggaccctggacggaccaaccgaggacaactataactttaacgtgtcggacgtaacggggtaaatacgggaacggggaaaagaaacgagtcgtttagggtttactaggttaatttaagttaacggttacctttaacctagttaccgttagggtaccgttacgggtacggggggtaaccgtaaaacggggggggtaccccgtaaccggggttaccctaaaccccgggttcccttaccccttaccgaaccggttcccctttaaccccgaaaccccgtaaaccgggggtaccccctaacggttccccgggtttcccctttccccccccggttggggccccctccccggtttcgaccccgttccccggaacggggaaccgtccccgtaacccggttcccgggtcggggggacccctaaccgggaaccgggtcccccgggg

SEQ ID NO: 438262 - DNA, 555 bp, Homo sapiens
  misc_feature: GZ8MTXP01C9C86.44.36.D03.1.454.CMB.2.raw
  modified_base (380)..(380): a, c, t, g, unknown or other
tcagacagtatatacacgaccggtgctcgatttagctgcgtcacgatctctcttggggggtcacaagaggcagcgctctcgggacgtctccaccatggcctgggctctgctgctcctcactctcctgactcaggacacggggacctgggcccagtccgccctgactcagccagcctccgtgtctgggtctcctggacagtcgctcaccctctcctgcactggaactaatactgatgttaggaaaatataaccttgtctcttggtaccaagtatacccaggtaaacccccaaactcctcttatgaaagtcaataagcggccctcggcatttctcatcgcttctcaggcctccaagtctggcaaacacgctgtgataattcngctcctgcctgacgacgaggcccgaactattattgctgctacatagtgcgggttcctagatagttgggtctttcgggcggtagggaccggccgttggaacccgtcgttagggtcaggcccaaggccgttcgcccccttggtccaaccgttctcgttccccgcccttccgttaacc

SEQ ID NO: 438263 - DNA, 508 bp, Homo sapiens
  misc_feature: GZ8MTXP01A8WFD.44.36.D03.1.454.CMB.2.raw
  modified_base (350)..(350): a, c, t, g, unknown or other
  modified_base (422)..(422): a, c, t, g, unknown or other
  modified_base (477)..(477): a, c, t, g, unknown or other
  modified_base (489)..(489): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcacctctcctgcactgaactatactgatgtagaaaatataactgtctctgacaagtataccagtaaacccccaaatccttcttatgaagtcaataagcgcctcgggctatttctcatcgcttctcacggctcaagtctggcaacncggctcgtgataattctgcctctgcctgacgacgaggaccgacttattattgctgctcagtatgcgtctagntagttggtcttggcggaggccgctcgaccgttcgtaggttcgacgcccaaggccncgcccctggtcnctcttcgtcccgcccttcc

SEQ ID NO: 438264 - DNA, 578 bp, Homo sapiens
  misc_feature: GZ8MTXP01CORGW.44.36.D03.1.454.CMB.2.raw
  modified_base (125)..(125): a, c, t, g, unknown or other
  modified_base (238)..(238): a, c, t, g, unknown or other
  modified_base (291)..(291): a, c, t, g, unknown or other
  modified_base (294)..(294): a, c, t, g, unknown or other
  modified_base (298)..(298): a, c, t, g, unknown or other
  modified_base (303)..(303): a, c, t, g, unknown or other
  modified_base (317)..(317): a, c, t, g, unknown or other
  modified_base (325)..(325): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctntggatacaccttcgccagctacgacattcatgtgtgtgacaggccctggataagggttgaatggatggtagggagctacgtcgtggacaagtggtaacacgaggctatgacanagtaagttcgagggcagtagcacatcgacgaggactacgcagagcacagccanagngganctgancagtcaggatacgngagagaanagtaagtagtgtacgtactagtgagacgaacgaacggaagaagaaacgaaagaaacgtaaaagtaaagttaagtttacgttacgaacgtacggacgggtaccgaacggtaaccgtcggggtaccgtaccgtctaccgaccgaccgacccaccgaaccgacgtccctacgtcccgtccctcccgcgccctacccgccgaacgaacgccgccgaccgtcggacgggaaccacggccggttccggtccggcggtcg

SEQ ID NO: 438265 - DNA, 624 bp, Homo sapiens
  misc_feature: GZ8MTXP01CZGU4.44.36.D03.1.454.CMB.2.raw
  modified_base (544)..(544): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccgtgggagggtccctgagactctcctgtgtcgcctctggatcacatcagtgaccactatatggacgtcgggtccgccgaggctaccgagggggaaggggctgggagtggcttgggccgacgaaagtaaaaaacaaggttcgacctaaagtcttttaagcaaacgaggacgtaccgccgcgtctagtagaaacgccaagtacttccaaccccttctacaaagagtatcgtaacctttacaaagggtaacttctaatttggaattcgtgaccgtaaattcggaaacctaaaccgtaacgaaaaaccccggnggaacgacggggacttaagttaggttaatttagttgttgtttggttattttaagatacgaagggtaacttcggtaacccg

SEQ ID NO: 438266 - DNA, 654 bp, Homo sapiens
  misc_feature: GZ8MTXP01BXWDM.44.36.D03.1.454.CMB.2.raw
  modified_base (202)..(202): a, c, t, g, unknown or other
  modified_base (275)..(275): a, c, t, g, unknown or other
  modified_base (300)..(300): a, c, t, g, unknown or other
  modified_base (310)..(310): a, c, t, g, unknown or other
  modified_base (392)..(392): a, c, t, g, unknown or other
  modified_base (457)..(457): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttatttacaaggtgtcagagtgaagtgngaggttggtggaggtccgggggatacgttggtccagccgtgggacgggtcctgagactctcctgtgtcgcctntggactcacatcagtgaccatatanggactggccncaggctaccgaggggagggcgtggagtcggcttggaccaaccaaagtaaaaaacgtaaggttcacccgtaaagtcctttaanacaacgtacgacgtaccgcgtacgtcgtagaacgaaacgccgtaagtaccttacccaacccttanaacgaaagagtaactacgtaacttaacgaaacgtaactagtaactttagtacttcgtaacgaacgtaaacttaacgtaaaacccgtaaaccgtaaaccggaaaaccggaaggaacggacggtacttaaagttagttaatttagtttgttacgtttaattagttaactaagtacgttaacggtaacgttcggtaaccg

SEQ ID NO: 438267 - DNA, 562 bp, Homo sapiens
  misc_feature: GZ8MTXP01DJ3T4.44.36.D03.1.454.CMB.2.raw
  modified_base (399)..(399): a, c, t, g, unknown or other
  modified_base (427)..(427): a, c, t, g, unknown or other
  modified_base (531)..(531): a, c, t, g, unknown or other
  modified_base (543)..(543): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcagttggtggagtccgggggagacttggtccagcctggagggtccctgagactctcctgtgtcgcctctggatcaccatcagtgaccactatatggactgggtccgccaggctccgaggggaaggggtctgggagtggcttggccgacaaagtaaaaaacaagttcgcccaaagcttttaagcaacagagtaccgccgntctgtagaaagccagtacttcacccctntacaaagagatagtacttacaaagggtaaactctaattgtaattcctgacaatgaacttaaccagaaaaccgaaggacagggcagtgtattaagttgttgtttntacgtttaatancgaggtaacttgtaacccg

SEQ ID NO: 438268 - DNA, 665 bp, Homo sapiens
  misc_feature: GZ8MTXP01EMHDM.44.36.D03.1.454.CMB.2.raw
  modified_base (368)..(368): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatagaacgaaaaatcctacagtacatctctagaagagactaagtttaaccatctaccaaggacacctacaaaaggcaggtggtacttagtatagaccaacatcggaccctgcggacaccaggacacatattaaacngtgacgaacgggtaatagggaacgggaaaagaaacgagtcgttaggtttactagttaatttaataagttacttaacctatcgtaggtacgtcgtaggggacgaaacgggggacctacgggtacacccggtactcctacgtagtacccttaccgaacccgtaacggggcccctaaggtccccgggttcccctttcccccggtccgggttcccgtcccccgttggcccttcccggacgggtaaccgcccgtaacccggttcgggtccggggggaccctaacggttccgggtccccgggg

SEQ ID NO: 438269 - DNA, 636 bp, Homo sapiens
  misc_feature: GZ8MTXP01AV3L8.44.36.D03.1.454.CMB.2.raw
  modified_base (388)..(388): a, c, t, g, unknown or other
  modified_base (404)..(404): a, c, t, g, unknown or other
  modified_base (539)..(539): a, c, t, g, unknown or other
  modified_base (602)..(602): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggatcaccatcagtgaccactatatggactgggtcccgccgaggctccgagggggaagggctgggagtggcgttcgggccgacgaagtaaaaacaagttcgaccctaagtctttaancacagacgtacgccgngtctgtagaaagcccagtacttcccgacccctctacaaaggagaactcgaaacctttacaaacgggtaaacctcgtaagtttgaatttccaggaccgtaaattcggaaaccctttaaaccgacggaaaaaccggnggaaccgacggggacttaagttaggtttaatttaggtttggttaggtttcgtttggttttaangtttaccggaagggttaaccttcgttaaccccgg

SEQ ID NO: 438270 - DNA, 611 bp, Homo sapiens
  misc_feature: GZ8MTXP01ELZ35.44.36.D03.1.454.CMB.2.raw
  modified_base (217)..(217): a, c, t, g, unknown or other
  modified_base (264)..(264): a, c, t, g, unknown or other
  modified_base (338)..(338): a, c, t, g, unknown or other
  modified_base (517)..(517): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggganacttggtccagccgtggagggtccctgagactctcctgtgtcgcctnggatcaccatcagtgaccactatagtggacgtgggtccgcaggctccgaggggaagggctggagtggctggcanaagtaaaacagttcgaccagtctttacaacgagcgtacgccgcgtctagtagaaacgccagtactccaccctatacaagagtatacgacttacgaaacgtaactactaagtttggaatttcgagaccgtaaatacgaaccttaaaccgtaaggaaaacccgtaggaacccgtacggggntaagttgttaatttagtttgtaggtttagttagtttacttagtaacaagggtaacctttggaccccgttagggtcggggaaccgtaaccggggg

SEQ ID NO: 438271 - DNA, 853 bp, Homo sapiens
  misc_feature: GZ8MTXP01A4DRL.44.36.D03.1.454.CMB.2.raw
  modified_base (280)..(280): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagtacgtttggtccatccgtgggacgggtccctgacgactctcctgtgtcgctntgatcacatcagtcgaccactatatgggactcgggtcccgccgaggcctaccggagggggaacggggctggggagtgggcttcgggccgtaacgaaaggttaaaaaaacaaggtttcgaccctaaaggttacctttttaagacccgtaaacgaagggtaccgggttacccgcccggtacgtttaccgtaggttaacggaaaacgtccccgaaaggtaacctttcccgaacccccttactaaccgaaacgggagtactacggtaaacctttacgaaaacgggtaacctttcgtaaatttcggtaaacttttccgaggaaccgtaaaacgttccggaaaaacccgtttaaaaccccgtaaacggggaaaaaaaccccgggtgggtaaaccccgggaaaacccgggggtttacttaaaacgggttttaacgggttttaaacgttttttaacggggtttttgggttttaacggggtttttaaacggttttttaacggtttttaaaacggtttaacccggtttaaaccggggttaaaaccggggtttaacccgtttaacccgggggttaacccccggg

SEQ ID NO: 438272 - DNA, 532 bp, Homo sapiens
  misc_feature: GZ8MTXP01BWOLN.44.36.D03.1.454.CMB.2.raw
  modified_base (246)..(246): a, c, t, g, unknown or other
  modified_base (335)..(335): a, c, t, g, unknown or other
  modified_base (372)..(372): a, c, t, g, unknown or other
  modified_base (383)..(383): a, c, t, g, unknown or other
  modified_base (388)..(388): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttgganatatactgtctcctgtatcaaacaacatcagacaaacgccccaaactcaattacttttgagttccagtgacgcggccgtacgtaggttntttactaagtcgtcttctctggctccagtctgccacnccgcccttccngtcgntctcgtcggcctcggctgacgacgagcgtgacttatacgtgccgtctactatttaacacttcgtgtacgtcgttgggtggttcgggacggttaggctcgaccgttcgacccgttcgacgtcacgccgagtccgttcgtcccccg

SEQ ID NO: 438273 - DNA, 740 bp, Homo sapiens
  misc_feature: GZ8MTXP01BN53U.44.36.D03.1.454.CMB.2.raw
  modified_base (321)..(321): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgtttattttacaaggtgtccagagtgaagtgcagttggtggaggtccgggggagtacgttggtccaggccgtgggacggtccctgacgactctcctgtcgtcgcctctgatcacatcagtcgaccactatagtggacgtcgggtcccnccgaggtcctaccggaagggggaacggggcgtggggaggtcgggcgttacgggacccgtaacaaaacggttaaaaaaacaaagggtttcgacccgtaaagttaccttttaagacctaaacgaacggtaacggtaacccggcccggtacgttcgtaggtaacgaaacggtcccaagtaccttacccaacccccttactacgaaaaggacgtactacggtaaacctttacgaaaacggtaaccttatatttacgtaatttcccgaggaacgtaaaactcggtaaaacccttaaacccgtaacgggaaaaaacccggaaggaacccggacgggtacttaagttaggttaattttagtttggttagtttaagggtttattttaaacgagtttacgaaacgggttaaccttaaggtaaccccgg

SEQ ID NO: 438274 - DNA, 634 bp, Homo sapiens
  misc_feature: GZ8MTXP01CBZFD.44.36.D03.1.454.CMB.2.raw
  modified_base (398)..(398): a, c, t, g, unknown or other
  modified_base (459)..(459): a, c, t, g, unknown or other
  modified_base (476)..(476): a, c, t, g, unknown or other
  modified_base (530)..(530): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagacgttggtccagccgtgggagggtccctgagactctcctgtgtcgcctctggattcaccatcagtgaccactatagtggactgggtccgccaggctccgagggggaagggggctgggagtgggcgttgggcccgacaaaggtaaaaaacaaaggtttcgaccctaaggtccttttaanaccaaacgtaaggaacgtacgcccgtcgtcgtaggtagaaacgccagtacttccaaccctntacaagagatagacttnaaacgtactacattgggatttctagacgaatcgaacctaacgtaagaaaaccgnggaacacgggcaagttgttaatttagttggttaggtttgttgtttaacttagttaaccgaagggtaaccttgtacccgttacggtcgggggcctaacccggggg

SEQ ID NO: 438275 - DNA, 653 bp, Homo sapiens
  misc_feature: GZ8MTXP01EJV7N.44.36.D03.1.454.CMB.2.raw
  modified_base (291)..(291): a, c, t, g, unknown or other
  modified_base (448)..(448): a, c, t, g, unknown or other
  modified_base (457)..(457): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtgggagggtccctgagactctcctgtgtcgctctggatcacatcagtnaccatatatggacgtgggtcccgccaggcctaccggagggggaggggctgggagtggcttgggccgacaagtaaaaaacaagttgacccaagtctttaagccacgtaagacgtaccgccgcggttctgtagaaacgcccagtacttccaaccccttntacaagganatgtaaacttcaaacgggtactactattagaattccgtaggtaccaaagttcgtaaacctaaacccgttaacggaaaaaaccccggtgggaacccgaacgggggtaccttaagttgggtttaatttagtttgggtttggtttaagtttagtttaacccttacgtagttaacggttaaaccgttcgttaaccccggg

SEQ ID NO: 438276 - DNA, 546 bp, Homo sapiens
  misc_feature: GZ8MTXP01CX48B.44.36.D03.1.454.CMB.2.raw
  modified_base (351)..(351): a, c, t, g, unknown or other
  modified_base (470)..(470): a, c, t, g, unknown or other
  modified_base (493)..(493): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggttgcgctgggttttccttgttgctattttagaaggtgtccactgtgaggtgcggctgggtggagtcgtggggggaggcttgggtacgagggcggggggggtccctggagactctcctgtgcagcctctggattcatcttcagtgactatgccatgaacgtgggtccgccaggctccgagggagggctggagtgggtttcattntgttaatattgcttggaagactacccacctactacgcagactctgtaggaacgggccattccaactaacttcccgagggacatcgaccaagactcactcgtatcctaggaaatgaaacngcctgagagaacgaggacacggntagtcttacgttcgttgttcggagtggacgtcgggacctaagtttcggtaacg

SEQ ID NO: 438277 - DNA, 611 bp, Homo sapiens
  misc_feature: GZ8MTXP01E3B07.44.36.D03.1.454.CMB.2.raw
  modified_base (365)..(365): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccagggaacggcccctggagtggcttgcacacatcttctcgaaatagaacgaaaaatcctaacagtaacatctctgaaagagactaagtttaaccatcctaccaaggaccacctaccaaaaggcaggtgtctttagatgaccaacatgacctgcgacacagcacatataacngtgacgacgggtaaatggaacgggaaagaaacagtcgttggtttactagttaattaattaagttctaactatcgtaggacgttcgtaggggacgaaacgggggaccacggtccaccggtcctcctcgacgtccttacccgaaccgaaccgggcccagttcccggtccctttcccccgcggttcccgcccgtgcccgttcccgaggaaccgcctaacccgtcggcggggacctaacggcggcccggg

SEQ ID NO: 438278 - DNA, 674 bp, Homo sapiens
  misc_feature: GZ8MTXP01D65YX.44.36.D03.1.454.CMB.2.raw
  modified_base (279)..(279): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagcttgggttttccttgttgttattttacaaggtgtccagagtgaagtgcagttggtggaggtccgggggagacttggtccagccgtggagggtccctgagactctcctgtgtcgctctgatcacntcagtgaccatatatggactgggtccgccaggctccggaggggagggggctgggagtggcttgggcctacaaaggtaaaaaacaagttcgacctaaagtactttaagcaacaaggacgtaccgccgcgttctaggtagaaacgccaagtacttacccaaccccttctacgaaaggagtaactacggtaaactttaccgaaaacggggttaaaccctttcttaagtttacgtactttaccgtagtaaccgtaaacgttacggtaaacccttaaaaccgtaaacgggaaaacccggaacgggaaccggacgggtacttaagttagtttaatttaggtttggttacggttttgtttaagtttaagtacgtacgttaacggttaacgttcggtaacccg

SEQ ID NO: 438279 - DNA, 569 bp, Homo sapiens
  misc_feature: GZ8MTXP01C04UH.44.36.D03.1.454.CMB.2.raw
  modified_base (342)..(342): a, c, t, g, unknown or other
  modified_base (364)..(364): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggaccccggcagaggtcatcatctcttgttctggaagcagttccaacatccggcccttaaattctgtatatggtaccagcaagtcccaggaccgcccccaaatcctcatctatagactaatcagccgccctgacggggtccctgaccgnttctctggctcaagtctcggcncctcacgccctcctggccatcacggtcgggccccggtcggaggacgtaggttgactttacactgcgcagtcgttgggggatcggaccgccgtggacgggtcttgggcttggttcgggacggacgggacccaaacgtcggaccgtccgttaggtcgacgcccgaggcctcgccccctggtccaccttcgtccgttccccgtaaccc

SEQ ID NO: 438280 - DNA, 859 bp, Homo sapiens
  misc_feature: GZ8MTXP01EUAYA.44.36.D03.1.454.CMB.2.raw
  modified_base (225)..(225): a, c, t, g, unknown or other
  modified_base (274)..(274): a, c, t, g, unknown or other
  modified_base (313)..(313): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccggggganacgttggtccagccgtgggacgggtccctgagactctcctgtgtcgctntggatcacatcagtcgaccatatagtggactcgggtccncaggcctccggaagggggaacggggtctgggggagttcgggcgttcgggacccgtacgaaaacggttaaaaaaacaaggtttcgaaccccgtaaaggttaccctttttaagacccaaacgagggtaaccggttaacccggcccgggtacgttaccgtagggtaacgaaaaccggcccctaaaggtaacctttacccgaaaccccccttgtaaaccgaaaggagtaaacttacggtaaaccctttaacaaaacggggtaaccctttacgtaaacttttaggaaacttttcccggaaggtaacccggttaaaaatttaccgggaaaaacccctttaaaacccgggtaaaaccgggaaaaaaaaccccggggtaagggtaaaaccccgggaaccggggggtaactttaaaggttacgggtttttaaaattttaacgggttttcgggttttacggggtttttaagggttttaacgttttttaaaacttaacgggttaacccgggttaaaagggggtttaaccctttttaacccgggggtaaacccccggg

SEQ ID NO: 438281 - DNA, 716 bp, Homo sapiens
  misc_feature: GZ8MTXP01BBO2F.44.36.D03.1.454.CMB.2.raw
  modified_base (208)..(208): a, c, t, g, unknown or other
  modified_base (424)..(424): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaggtgtcagagtgaagtgcagttgggngggaggtccgggggagtacgttggtccagccgtgggacgggtccctgagtctctcctgtgtcgctcgtgactcacatcagtcgaccatatagtggactcgggtccacgaggctccggaagggggaacggggctgggaggtggcgttcgggacccgtaacaaagtaaaaaacgaagttcgaccctaaagtcctttaatcaacgagacgtaccgccgngtctgtagaaacgccagtacttaccctaccccgtactacgaaacgagtaacttacgtaactttaaccaaaacgggtaaacccttacgttaagtttacgtaaactttccgtaggaacccgttaaaagttaccggtaaacccttaaaacccgaaacgggaaaaaacccggaagggaaacccgacgggggtaaacttaagttacggtttaaatttaggtttggtttaggttttaacgggtttattttaaagttacgttacggttaaaacgggtaaccgtttcgggttaaccccgg

SEQ ID NO: 438282 - DNA, 714 bp, Homo sapiens
  misc_feature: GZ8MTXP01A7BJS.44.36.D03.1.454.CMB.2.raw
  modified_base (260)..(260): a, c, t, g, unknown or other
  modified_base (270)..(270): a, c, t, g, unknown or other
  modified_base (310)..(310): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctgggtggagtcgtgggggagcgttggtacgagggcgggggggtccctgagactctcngtgcagcctnggattcatcttcagtgactatgccatgaacgtcgggtccncgaggcctaccggagggggaggcgtggaggttgggtttaccattagttagttaatagtttgacgtgggacgtaactacccgaacccttacgtaacgctaacggacttcgtaggtacgggaaacggggtccctaaatttacccaacccgttaaacgttcccgaaaggggaaacctaaacgttcggaacccctaaaagggtaaacccttctaaccgttaggttaaacttaccggttaagggaaaattaccggaaacgtacggtacccgtaagggaaacggaaagggtaacggaacggggaaccgttaaccgggtccttaggtttacccgttaaccgttttcgtaaccgggtttacggaaggaacggtaacggtttcccgggggaacccctttaacgggtttcgggg

SEQ ID NO: 438283 - DNA, 678 bp, Homo sapiens
  misc_feature: GZ8MTXP01CU8CX.44.36.D03.1.454.CMB.2.raw
  modified_base (543)..(543): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttatttacaaggtgtcagagtgaagtgcagttggtggaggtccgggggagacgttggtccagccgtggagggtccctgacgactctcctgtgtcgcctctggatcaccatcagtcgaccactatagtggactcgggtccgccacggctaccggagggggaacggggcgtgggagtggcgttgggccgaccgtaaaggtaaaaaaacgtaaggttcgaccctaaagttacctttaataccgtaaaccgaaggtaacgggtaacccggcccggtacgttccgttagggtacgaaaacgccgaaggtaccttacccaccccttctacgaaagacgtatacgtacttacaaacggaacttctaattgatttcngacgtaaagtacgtaaaccgtaaacctaaggaaaaacccgaagggaaccgaacggggtcaaggttagttaagtttagtttggtttaggtttggttactttaattaacgtcgttaacggtaacgttcgtaacccgg

SEQ ID NO: 438284 - DNA, 837 bp, Homo sapiens
  misc_feature: GZ8MTXP01BG8RE.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgtagttggtgggaggtccgggggagtacgttcggtccaggccgtgggacgggtccctgacgactctcctgtgtcgctctgatcacatcagtcgacctactatagtcggacgtcgggtcccgccgaggccgtaccggaggggggaacgggggcgtgggggaggttcgggcgttcggggacccgtaacgaaaacggttaaaaaaacgtaaaggtttcgacccctaaaggttacctttttaacaccgaaacgtaacggtaacggtaacccgggtccccggtacggtttacccgttagggtaacggaaaaaaccggcccgtaaaggttaaccctttaccccgtaaaccccccttcgttaaaccgaaaaggggtactaaacgttacgtaaaacccttttaacccgaaaaaggggttaaacccctttacttaaagttttagggaaacctttttcgaacggtaacgtaaaacgttcgtaaaacccgttaaaccgtaaacgggaaaaaaccccggtaagggaaccccgttaaagggggaccttaaagtttgggttaaatttttaggtttggtttagttttggtttaccggttttaattacggttaacgttaacggggttaaccctttcgggtaaccccggg

SEQ ID NO: 438285 - DNA, 608 bp, Homo sapiens
  misc_feature: GZ8MTXP01AL8HJ.44.36.D03.1.454.CMB.2.raw
  modified_base (281)..(281): a, c, t, g, unknown or other
  modified_base (319)..(319): a, c, t, g, unknown or other
  modified_base (392)..(392): a, c, t, g, unknown or other
  modified_base (444)..(444): a, c, t, g, unknown or other
  modified_base (486)..(486): a, c, t, g, unknown or other
  modified_base (525)..(525): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccaggcccgtgggacgggtccctggagactctcctgtgtcgcctntggatcacatcagtcgaccactatatgtacgtggtccncaggctccggaggggagggctgggagtggcttggccgacaaagtaaaacaagttcgaccctaaagtctttaancaacgagtacgtaccgcgcgttctgtagaaagcccaagtacttccacccctntacaagagatgacttacaaaggtactctattacgatttccgngacgtaaatcgtaaaccctaaccgtaacggaaaacccgnggaacccacggggcttagttaggttaatttagtttgttacgttggttatttaatacgtacgacgggtaacttcggtaaccccg

SEQ ID NO: 438286 - DNA, 594 bp, Homo sapiens
  misc_feature: GZ8MTXP01EQA6H.44.36.D03.1.454.CMB.2.raw
  modified_base (304)..(304): a, c, t, g, unknown or other
  modified_base (478)..(478): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaggtgtcagagtgaagtgcagttggtggaggtccgggggagacttggtccagcctgggagggtccctgagactctcctgtgtcgctctggatcaccatcagtgaccactatatggactgggtccnccaggcctccgaaggggaggggctgggagtggcttgggccgacaaaggtaaaaacaagttgcccaaagtctttaatcaacagacgtacgccgagtctagtagaaacgccagattccacccctctacaaagtagatgaactttccgaaaggtaaacttcaatttggactttccgnggtcgaaaattcgaacctaaacctacggaaaaccggaaggaaccgaggggcttagtaggttaatttagttggttagtttgttagtttaactgtacgaggtaaccgttgtaacccgg

SEQ ID NO: 438287 - DNA, 558 bp, Homo sapiens
  misc_feature: GZ8MTXP01AFUDU.44.36.D03.1.454.CMB.2.raw
  modified_base (225)..(225): a, c, t, g, unknown or other
  modified_base (237)..(237): a, c, t, g, unknown or other
  modified_base (435)..(435): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctcctggtatcaacatcatccaggtaaacgcccccaaatcatcatctatgaggcctataagacggcctcgaggggtttctaacttcgcttcactgcctccaagtcccgacaacacggcctcctgacatctctgggctccgaggctgaggacgaggctgatttatagttgtgctcgagtnttgttcgtcgctatcctatttatgttcgtttacgggaagttcggggaacctaagggttcccaaccggttccgtaagggttccaacggccccaaacgggttccccaaacccccgaacttcccgg

SEQ ID NO: 438288 - DNA, 628 bp, Homo sapiens
  misc_feature: GZ8MTXP01EKTLH.44.36.D03.1.454.CMB.2.raw
  modified_base (342)..(342): a, c, t, g, unknown or other
  modified_base (404)..(404): a, c, t, g, unknown or other
  modified_base (597)..(597): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatagaacgaaaaatcctaacagtacatctctagaagagctaagtttaaccatctaccaaggaccacctaccaaaaggcagggtgttactttagtatagaacccaaanatcggacccctggaccggaacaccgaggacactatattaaactgtgacgaacggggttaaanagggaacgggaaaagaacgtagtcgttagtttactagtaatttaataagttacttactatcgtaggacgtcggtacgggaacgaaacgggggaccgtacggtccacccgtctccctacacgtccctaccgaaccgacggccctacgtcccggttcccgttccccgtcggcccgtcccgtcgccgccgacggcnccgaaccgtcggcggggaccaacgcggccgg

SEQ ID NO: 438289 - DNA, 750 bp, Homo sapiens
  misc_feature: GZ8MTXP01CK8QE.44.36.D03.1.454.CMB.2.raw
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagcttgggttttccttgttgttatttacaaggtgtcagagtgaagtgcaggttgggtgggaggtccgggggagtacgttggtccagccgtgggacgggtccctgacgacttctcctgtcgtcgcctcgtggtatcaccatcagtcgaccactatagtggacgtcggggtcccgccgagggccgtaccggaggggggtaagggggtccgtgggggtaggttcgggcgtttcggggacccgtaaccgtaaaacggttaaaaaaacgtaaggtttcgaccctaaagggttacctttttaacgactaacgaggtacgtaccggcccgtcggtactggtacgaaacggcctaaggtacttacccgaaccccttctaaccgaaggtacgattacggtaacctttaaccgaaagggtaacccttaggtaactttacggtaacttttccgacgtaaccggtaaactacggtaaaccccttaaacgtaacggaaaaaaccccggtgggaaaccgttacggggtacttaaagttggttaatttagttggtttagttttgttaggttttaataaccgttaggaacggttaaccgttcggttaaccccgg

SEQ ID NO: 438290 - DNA, 601 bp, Homo sapiens
  misc_feature: GZ8MTXP01BIX0B.44.36.D03.1.454.CMB.2.raw
  modified_base (218)..(218): a, c, t, g, unknown or other
  modified_base (263)..(263): a, c, t, g, unknown or other
  modified_base (303)..(303): a, c, t, g, unknown or other
  modified_base (376)..(376): a, c, t, g, unknown or other
  modified_base (386)..(386): a, c, t, g, unknown or other
  modified_base (458)..(458): a, c, t, g, unknown or other
  modified_base (522)..(522): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctggaggtccctgagactctcctgtgtcgcctntggacttcaccatcagtgaccatatagtggactgggtccnccgaggcctccggaggggagggctgggagtggcgttggaccgagaaagtaaaacaagttcgaccagtctttanccaaacgagngtacgccgcgtctaggtacgaaagccagtacttccaccctctacaagagatacgaacttacgaaagtacctntaagtttggtactttcgtgacgtaatcgaaacctaaccgtaagaaaacccggtggaacacgggnaagttgttatttagttgttagttgtttgtttattacttcgaggtaactcggtacccagggtccggggccgtaaccgggg

SEQ ID NO: 438291 - DNA, 553 bp, Homo sapiens
  misc_feature: GZ8MTXP01AGK6L.44.36.D03.1.454.CMB.2.raw
  modified_base (196)..(196): a, c, t, g, unknown or other
  modified_base (224)..(224): a, c, t, g, unknown or other
  modified_base (249)..(249): a, c, t, g, unknown or other
  modified_base (355)..(355): a, c, t, g, unknown or other
  modified_base (430)..(430): a, c, t, g, unknown or other
  modified_base (440)..(440): a, c, t, g, unknown or other
  modified_base (495)..(495): a, c, t, g, unknown or other
tcagacagtatatacacgaccggtgctcgatttagctgcgtcacgatctctcttggggtgggcacaagaggcagcactcaggacaatctccagcatggcctggtctcctctcctcctcactctcctcgctcactgcacagggtcctgggcccactctgtgctgacgcagccgccctcagtgtctggggccccgggnagagggtcaccatctcctgcactgggancagatccaacatcgggacagattcngatgtccatggtaccaacaccttccaggaaccacgcccccaaatcctacatctttaggaaacaactatccggccctcgacgggggtccccctggaccgtatttccnctcgggccttcccaaagtcctgggccaccgtcacgccctccctggcccatcactgggctcccgaggctagaacgngtgaggggtntagttattactcgcctagtccctagtcgactgcacgcctcgaggttggttggggngttcgggcgggttacgggaccaggtctgaacccggtcctggggccaacgcccgaacgg

SEQ ID NO: 438292 - DNA, 591 bp, Homo sapiens
  misc_feature: GZ8MTXP01DZ8YE.44.36.D03.1.454.CMB.2.raw
  modified_base (321)..(321): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggacacctacaaaaggcaggtgtctttagtatgaccaanatggaccctgcggacacaggcacatataactgtgcacgggtaaatggacgggaaagaacagtctgtttctgtattataagtacttactatctaggcgtcgtaggggacgaaacgggggaccgtacggtaccaccgtcctccgtcacgtccttcccgaccgtaacggggcccctacgtcccggttcccttcccccgtcggcccgtccccgtcgcccgttcccgacggaacgcccgaacccgtcggtcgggggcctaaccgcggtccccggg

SEQ ID NO: 438293 - DNA, 561 bp, Homo sapiens
  misc_feature: GZ8MTXP01AWXKH.44.36.D03.1.454.CMB.2.raw
  modified_base (191)..(191): a, c, t, g, unknown or other
  modified_base (225)..(225): a, c, t, g, unknown or other
  modified_base (237)..(237): a, c, t, g, unknown or other
  modified_base (553)..(553): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccaggtaaacgcccccaaatcatcatctaatgagcctataagacgccctcgaggggtttctaactcgcttcactcgacctccaagtccgcaacaccggcctccctagacaactctcgtcgggctccgaggctggagacgagtctgatttattagttgttgctacagtattgttcgtcgctatctaactttgtgttcgtttacgggaaagttcggggaacctaaggggttcccttaccgttccgttaaggtccaacggaccccaagggcccaaaccccgnttaacccg

SEQ ID NO: 438294 - DNA, 659 bp, Homo sapiens
  misc_feature: GZ8MTXP01D7OHP.44.36.D03.1.454.CMB.2.raw
  modified_base (310)..(310): a, c, t, g, unknown or other
  modified_base (350)..(350): a, c, t, g, unknown or other
  modified_base (377)..(377): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcatcatggagttcgggctgagctgggttttccttgttgttattttacaaggtgtccagagtgaagtgcagttggtggagtccgggggagacttggtccagccgtggagggtccctgagactctcctgtgtcgctctggattcaccatcagtgaccactatagtggactggggtccncgaggctccgaggggaagggctggagtggctggccccganaaagtaaaacagttcgaccagtcttancacagagtacgcgtcgtctgtagaaacgccagtactttaccacccttactaccgaaagacgactagtaacctttacgaaaacgtaaccttactaagtttgaatttccgtagacgtaaacgtcgtaaacccttaaaacccgaacgggaaaaaaacccggtgggaaccgtaaaccggggacttaaagtttagtttaaacgttttagttttagggtttggtttttaacggtttaagttttttaaactagttacccgggtaaagggttaaacccgttttcccgggg

SEQ ID NO: 438295 - DNA, 582 bp, Homo sapiens
  misc_feature: GZ8MTXP01A4GCO.44.36.D03.1.454.CMB.2.raw
  modified_base (218)..(218): a, c, t, g, unknown or other
  modified_base (282)..(282): a, c, t, g, unknown or other
  modified_base (303)..(303): a, c, t, g, unknown or other
  modified_base (340)..(340): a, c, t, g, unknown or other
  modified_base (368)..(368): a, c, t, g, unknown or other
  modified_base (372)..(372): a, c, t, g, unknown or other
  modified_base (375)..(375): a, c, t, g, unknown or other
  modified_base (492)..(492): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccggggganacttggtccagccgtggagggtccctgagactctcctgtgtcgcctctggattcaccatcagtnaccatatatggactgggtccncaggctcgagggagggctgggagtggcttgggccganaaagtaaaaacaagtcgaccagtcttancaanagngtacgcgcgtctgtacgaaacgccagtacttccaccctctacgaaagacgatagaccttacgaaagtaactcattaggaattcgtagcgtaaatcgaactaaacgtagaaaacccgngaacgacgggctaagtgttattagttggtgttgtttagttattatccgaggtaacttcgggaccacgggttcggggaacccgtaacgggg

SEQ ID NO: 438296 - DNA, 667 bp, Homo sapiens
  misc_feature: GZ8MTXP01A7FHH.44.36.D03.1.454.CMB.2.raw
  modified_base (425)..(425): a, c, t, g, unknown or other
  modified_base (486)..(486): a, c, t, g, unknown or other
  modified_base (528)..(528): a, c, t, g, unknown or other
  modified_base (591)..(591): a, c, t, g, unknown or other
  modified_base (641)..(641): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtgggaggtccggggggagtacgttcgggtcccaggccgtggggacgggttccctggacgtaccttctcctgtcgtccgcctcgtggactcaccatcagtcgaccatatagtggacgtcgggtcccgccgaggcctaccggagggggaaggggcgtgggagtggcgttgggaccgacgaaaggtaaaaacgaagttcgacctaaagtactttaancaacgaggtacgtaccgccgtcgtcgtaggtagaaacgccgaatacttcccaaaccccttntaacgaaagactacgtacgtaacttaacgaaacgttaacttntaagtttcgtaactttcgagtaacgtaaagtaccgtaaacctaaaccgaaacggaaaaccggnggaaccggaggtacttagtagttattagtttggttgttaattagtttaanactacggttacggtaacttcggtccg

SEQ ID NO: 438297 - DNA, 578 bp, Homo sapiens
  misc_feature: GZ8MTXP01BTHFH.44.36.D03.1.454.CMB.2.raw
  modified_base (478)..(478): a, c, t, g, unknown or other
  modified_base (509)..(509): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctctggatcaccatcagtgaccactatatggactgggtcccgccaggctccgaggggaacggggctgggagtggcttgggccgacaaggtaaaaacaagttcgacccaaagtcttttaagcaacgagacgtaccgccgacgtctgtagaaacgccagactttccacccctctacaaagagatgacttaccaaaggtactcattgattcgngacgaatgtaaacctaacctagaaaacccgngaacgttacgggcagtgtaatttagttgttgttgttacgtttaatatcgttagggtaacttgtaacccg

SEQ ID NO: 438298 - DNA, 668 bp, Homo sapiens
  misc_feature: GZ8MTXP01CDVMK.44.36.D03.1.454.CMB.2.raw
  modified_base (209)..(209): a, c, t, g, unknown or other
  modified_base (224)..(224): a, c, t, g, unknown or other
  modified_base (272)..(272): a, c, t, g, unknown or other
  modified_base (312)..(312): a, c, t, g, unknown or other
  modified_base (339)..(339): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtcagagtgaagtgcaggttggnggaggtccggggganacgttggtccagccgtgggacggtcctgagctctcctgtgtccgcctnggatcaccatcagtgaccactatagtggactcgggtcccncgaggcctacggagggggaaggggtcngggagtcggcgttcggaccgaccgaaaggtaaaaaacagttacgccaaacgtactttaatacaacgaaggtacgtacgacccggcgtacctgtagaaacgaccgtacgattaccacccctactactaattaagactacgtaactactaaacgaacttactattagtactttcacgacgtaaacgttacgaacccgtaaacctaaacggaaaaccgggaaacggtaaccggaacggggtacaagtttaggttaattttagtttagggttgttttaagttaccggtttaatttaaatcggttaacggttaaaccgttcggtttaaccccgg

SEQ ID NO: 438299 - DNA, 607 bp, Homo sapiens
  misc_feature: GZ8MTXP01D5TEK.44.36.D03.1.454.CMB.2.raw
  modified_base (377)..(377): a, c, t, g, unknown or other
  modified_base (427)..(427): a, c, t, g, unknown or other
  modified_base (451)..(451): a, c, t, g, unknown or other
  modified_base (512)..(512): a, c, t, g, unknown or other
  modified_base (522)..(522): a, c, t, g, unknown or other
  modified_base (556)..(556): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagacgttggtccagccgtggagggtccctgagactctcctgtgtcgcctctggattcaccatcagtgaccatatatggactgggcccgcgaggctccggaggggagggctgggagtggcttggccgacaaagtaaaacaagttcgacctagtctttancaacgagcgtacgccgcgtctggacgaaacgccaagtcttcccaaccctntacgaaagacgattacgaacttanaaacgtaactctaatttcgggaattccgtagacgtaaatcgaaactaacgagaaaaccggngaacgcgggnaattgttaattgttgtttgtttgttacgttttanacgtcaaagggttaactcgggtaccacgggttcggggaaccgtaaccgggg

SEQ ID NO: 438300 - DNA, 676 bp, Homo sapiens
  misc_feature: GZ8MTXP01DSUZ6.44.36.D03.1.454.CMB.2.raw
  modified_base (290)..(290): a, c, t, g, unknown or other
  modified_base (490)..(490): a, c, t, g, unknown or other
  modified_base (495)..(495): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtggaggtccgggggagtacgttggtccgagccgtgggacgggtccctgacgactctcctgtcgtcgcctcgtgatcacntcagtcgacctactatagtggacgtcgggtccgccgaggctccggagggggaagggggcgtaggggtaggtcggtcgttgggacccgtaacgaaaggtaaaaaaaaccgtaaggtttacgacccgtaaagttacttttaagaccaacgtaggacgtaccgccgtcgtactgtagaaacgccagtacttacccacctctanaaganactagaacttacgaaaggtaactctaatttacgtacttcgtagacgtaaagtcgtaaaccttaaaccgacggaaaacccggaaggaaccgacgggtacttaaagtttgttaagtttaagtttggtttagtttcggtttaagttttaattagtacgttaacggtaacgttcggttaacccgg

SEQ ID NO: 438301 - DNA, 589 bp, Homo sapiens
  misc_feature: GZ8MTXP01CXPJX.44.36.D03.1.454.CMB.2.raw
  modified_base (384)..(384): a, c, t, g, unknown or other
  modified_base (472)..(472): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgctctggatcaccatcagtgaccactatatggactcgggtcccgccaggctccgagggggaagggggctgggagtgggcttgggccgacaagtaaaaacagttcgccaagtctttaancacagacgtaccgccgcgtctgtagaaacgccagacttccacccttctacaagagatgaacttacgaaaggtaactcgtattgattcngacgtaatcgtaaacctaaccgtaacggaaaacccggaaggaaccgacggggacttaagttaggttatttagtttggttagtttgttagtttaatatcgaggtaacttcgtaacccg

SEQ ID NO: 438302 - DNA, 587 bp, Homo sapiens
  misc_feature: GZ8MTXP01B5GLS.44.36.D03.1.454.CMB.2.raw
  modified_base (288)..(288): a, c, t, g, unknown or other
  modified_base (308)..(308): a, c, t, g, unknown or other
  modified_base (372)..(372): a, c, t, g, unknown or other
  modified_base (422)..(422): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtcagagtgaagtgcagttggtgggaggtccgggggagtacgttggtccagccgtgggagggtccctgagactctcctgtgtcgctctggatcacatcagtnaccatatatggactcggccncaggctcgagggagggctggagtggctggccacgaaagtaaaaacaagtcaccaagtctttaancaagagtacgtaccgccgcgtctgtagaaacgccagtacttaccaccctntacaagagatcgaacttacgaaagtaacttctaatttgaatttcgagacgtaaatcgtaaactaacccgtaagaaaacccgggaagaaccgaaggggtcaagttaggttaatttagttggttgtttaagttcgtttaatagtcgttaaggtaacttcgtaacccg

SEQ ID NO: 438303 - DNA, 691 bp, Homo sapiens
  misc_feature: GZ8MTXP01B3QKV.44.36.D03.1.454.CMB.2.raw
  modified_base (318)..(318): a, c, t, g, unknown or other
  modified_base (394)..(394): a, c, t, g, unknown or other
  modified_base (464)..(464): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttgggtgggaggtccggggggagtacgtttggtccaggccgtgggagggtccctgagactctcctgtgtcgctctggatcacatcagtcgaccactatagtggactcggtccncgaggctccgagggggagggctgggagtggctgggccacgaaagtaaaaacaagttcgacctaaagtccttttaanacgaaacgaggtacgtaccggccgtacgttactaggtaacgaaacgcctagtaccttacccaaccccttntaacgaaagacgtaatacgtaacctttaacgaaacggttaacttcgttaatttacgtaactttccgtaacggtaacgtaaaacgtccgtaaaacccttaaaccggtaaacgggaaaaacccggaagggaacccggttacggggtaacttaagtttagtttaattttacgtttggtttagttttaagtttatttaacgtagtacgttaaggtaaccgtttcgtaaccg

SEQ ID NO: 438304 - DNA, 628 bp, Homo sapiens
  misc_feature: GZ8MTXP01CF3WT.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctaacagtacatctctagaagagctagtttaaccatctaccaaggacacctacaaagcaggtgtactttagtatacgaccaacagtcggaccctgacggacaccgaggacactatacttaactgtgacgtaacgggtaagtacgggaacgggaaaagaaacgtagtcgttaggtttactaggttaatttaagttaaagttaccttaacgtattcgtggtacgtcgtaggggaacgaaacgggggaccgtacggtaccaccgtcctcctcacgtccttaccaccgacggccctacgtcccggtcccttccccgtcggccgtccccgtcgaccgttccgacggtccgccctaaccgtccggtcgggggactaaccggcggccccgg

SEQ ID NO: 438305 - DNA, 633 bp, Homo sapiens
  misc_feature: GZ8MTXP01BSXJ5.44.36.D03.1.454.CMB.2.raw
  modified_base (278)..(278): a, c, t, g, unknown or other
  modified_base (315)..(315): a, c, t, g, unknown or other
  modified_base (372)..(372): a, c, t, g, unknown or other
  modified_base (387)..(387): a, c, t, g, unknown or other
  modified_base (391)..(391): a, c, t, g, unknown or other
  modified_base (437)..(437): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccaggcccgtgggacgggtccctgagactctcctgtgtcgcctntggatcacatcagtgaccactatatggactgggtccnccgaggctccgaggggagggctgggagtggcttggccgacaaagtaaaaacaggttnacccaagtctttaancaanagacgtaccgccgcgtctgtagaaacgccagtacttccaacccctntacgaaagataatcgaactttacaaagggtaacttctagttagtaacttcgtagacgtaaatcgtaaaccttaaaccgtaacggaaaaacccggaagggaaccgacgggggtaccttaagtttaggttaattttaaggtttgttaggtttgttagttttaatacgttcgaaaggttaaccgttcggttaaccccgg

SEQ ID NO: 438306 - DNA, 650 bp, Homo sapiens
  misc_feature: GZ8MTXP01AN7GR.44.36.D03.1.454.CMB.2.raw
  modified_base (430)..(430): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacgccctggagtggcttgcacacatcttctacgaatagaacgaaaaatcctaacagtacatctctagaagagctaacgtttaaccatactaccaaaggaccaccctaaccgaaaaggctaagggttcgtactttaagtatacgaaccaaacagtacggaccctggacggacaccacggacaactatagttaaacctgtggacgaacggggtaataggaaccggggaaaanaaacgagtcgtaggtttactagttaattattaagtcttaactatcgtaggacgtcggtaggggaccgaaacgggggaccgacggtccaccgttcctcccgtacgacggtaccctacccgaccgtaaccgggccctacgtccggtcccttccccgtcggcccgcccgtcgcccgccgacggaacgcgaacccgttcggcgggggcctaacgccggcccggg

SEQ ID NO: 438307 - DNA, 603 bp, Homo sapiens
  misc_feature: GZ8MTXP01B6MXE.44.36.D03.1.454.CMB.2.raw
  modified_base (386)..(386): a, c, t, g, unknown or other
  modified_base (443)..(443): a, c, t, g, unknown or other
  modified_base (450)..(450): a, c, t, g, unknown or other
  modified_base (474)..(474): a, c, t, g, unknown or other
  modified_base (524)..(524): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcttgttgttatttacaaggtgtcagagtgaagtgcaggttggtggaggtccgggggagacttggtccagcctggagggtccctgagctctcctgtgtcgcctctggatcacatcagtcgaccatatatggacgtgggtccgcgaggctccggagggggaaggggctgggagtcggcgttgggccgacgaaaggtaaaaacaagttcgcccaaagttctttaanacaacgagacgtaccgccgtcgtctaggtagaaacgccaagtacttccaaccccttnacaaggnatgaacttcaaagggtaacctttntagttgtacttcgagacgtaatacgtaaacctaaacgaacggaaaacggnggaacgacgggtacttagttagttattgtttgttgtttgttagtttaactacgtacgttacggtaaccgttcgtaaccg

SEQ ID NO: 438308 - DNA, 658 bp, Homo sapiens
  misc_feature: GZ8MTXP01B4PKB.44.36.D03.1.454.CMB.2.raw
  modified_base (218)..(218): a, c, t, g, unknown or other
  modified_base (379)..(379): a, c, t, g, unknown or other
  modified_base (472)..(472): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctgggagggtccctgagactctcctgtgtcgcctctggattcaccatcagtgaccactatatggactgggtccgccaggctccgagggggaagggctgggagtgggcttgggccgacaaaggtaaaaacaaggttcgaccagtctttancaaacagaacgtaccgccgcgtctggtagaaacgcccagtacttacccaccctctacaaaggagacttacgaacttacgaaaagtaacccttnaagtttgggaacttttcgacggtaaccgtaaattcggaaacccttaaacccgtaacggaaaaacccggtagggaacccgaacgggggacaagttagttaaatttagtttggttgtttagtttgtttaattacgttaacgaggtaaccttcgtacccgttagggtccgggggaaccgtaaccggggg

SEQ ID NO: 438309 - DNA, 643 bp, Homo sapiens
  misc_feature: GZ8MTXP01DI0BL.44.36.D03.1.454.CMB.2.raw
  modified_base (322)..(322): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaaatcctacagtacatctctagaagagctagtttaaccatctacaagacacctacaaaggcaggtgtcttagatgaccaanatcggacctgcgacaccaggcacatattaactgtgacgaacgggtaaatggaacgggaaaagaaacgagtcgttggtttactagttaattaattaagttaccttaacctattcgtaggaccgttcggtaggggtaaccgaaacggggggtacccaacgggttacccaacccggtcctcccgtcgtacggtacccttacccgaacccgaacggggcccctaacgtccccggttacccttcccccgtgggccccgtccccgtcgcccgttccgacggtccgccgtaacccgtcggtacgggggacctaaccgcggtccccggg

SEQ ID NO: 438310 - DNA, 765 bp, Homo sapiens
  misc_feature: GZ8MTXP01CJAA8.44.36.D03.1.454.CMB.2.raw
  modified_base (286)..(286): a, c, t, g, unknown or other
  modified_base (291)..(291): a, c, t, g, unknown or other
  modified_base (318)..(318): a, c, t, g, unknown or other
  modified_base (402)..(402): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgtaggttggtggaggtccgggggagtacgttggtcgtagccgtgggacgggtccctggacgtctctcctgtgtcgcctgtgntcacntcagtgaccatatagtggacgtggccncgaggctcggagggggagggctgggagtcggcgttggaccgtaacgtaaaggtaaaaacaagttcgaccctaaagttctttaancaacgaggtacgtaccgccgtcgtctaggtaacgaaacgcccgtaaagtccttacccaaccccgtttctaaacaaagggtacttaacgtacgtaacctttaacgaaaacgggtaacctttactaaagtttcggtaacttttccgtaaggaaccgttaaaacgttaccggtaaaaacccctttaaaaccggtaaaccgggaaaaaaacccgggtaacggggtaaacccggaaccgggggtaaccttaaaggtttaaggtttaatttttaagggtttttgggtttaggtttttaagggttttaaccgtttttaaagtaacgttaccggttaaaaggggtttaaacccttcgggttaacccccggg

SEQ ID NO: 438311 - DNA, 664 bp, Homo sapiens
  misc_feature: GZ8MTXP01EKF9L.44.36.D03.1.454.CMB.2.raw
  modified_base (282)..(282): a, c, t, g, unknown or other
  modified_base (326)..(326): a, c, t, g, unknown or other
  modified_base (412)..(412): a, c, t, g, unknown or other
  modified_base (446)..(446): a, c, t, g, unknown or other
  modified_base (582)..(582): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagtgcaggttggtggaggtccgggggagtacgtttggtccaggccgtgggacgggtccctgacgactctcctgtgtcgcctntggtatcaccatcagtgacctatatagtggacctcggggtcccncgaggcctacggagggggaacggggctgggagtggcttcgggacctaccgaaaggtaaaaaacagttcgaccctaaagtctttaancgaacagacgttacgccgtcgtctagtagaaacncccaagtacttacccgtacccctacttacgaaaggagtacttacggtaaacctttacgaaacgggtaaccttacgtaactttaggactttaccgagtaaccgtaaatcgtaaacctaaaccgtacgaaaacccggnggaaccgttcgggattaagttggtaatttagttgttagtttaagttagtttaactgtacgttaacgtaactttcggtaaccg

SEQ ID NO: 438312 - DNA, 656 bp, Homo sapiens
  misc_feature: GZ8MTXP01ECQ8L.44.36.D03.1.454.CMB.2.raw
  modified_base (592)..(592): a, c, t, g, unknown or other
  modified_base (620)..(620): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccgtggagtggcttgcacacatcttctcgaatagaacgaaaactcctaacagtacatctctagaagagactaagtttaaccatcctaccaaaggaccaccctaaccgaaaaggcgtagggttggttactttaagtactacgaacccaaacgacgtacggaccctggaccggaacaaccgacggacactaattacttaactggtcggacgtaaacggggtaaatacgggaacggggaaaagaaacgtagtcgtttggtttactagttaattaattaacgttcttaactatcgtaggacgtcgtaggggaacgaaacgggggccacgggtccaccgtctcctcgacgtcctaccaaccgaacgggccctacgtcccgttcccttccccgnggccctcccgtcgcccgttcgacgggcnccgtccgtcgggacgggggctaaccggcggcccggg

SEQ ID NO: 438313 - DNA, 689 bp, Homo sapiens
  misc_feature: GZ8MTXP01ACU8B.44.36.D03.1.454.CMB.2.raw
  modified_base (235)..(235): a, c, t, g, unknown or other
  modified_base (270)..(270): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgtcttgggttttccttgttgcttattttagaaggtgtccatgtgaggtgcggctggtggagtcgtgggggagtcgttggacgngggcggggggtcctgagctctctgtgcagcctcgnggattcatcttcagtgactatgcctagtgaacgtcgggtccgccgaggccgtaccggagggggagggtcgtggaggtttcgggtttaccattagttagttaaatgttaggcgtggaacgtactacccacctacgtacgcagtacttacgtggtacggaacggggtcctattaccgaacctaaacgttccccggaagggaacctaaagtcccggaaacccaaacggggtaacccttaccgtaaccgttaggtaaccgtttaccgaaagggtaaaacgttaacgaaaccgacggtacccgtaagggaacggaaacggaaaccgggaacggaacccggttacgggtacctttcggttacccgtttcttccgttaagggtacgaaggacgtacgggttcccgggaacgtttaaccggtttggg

SEQ ID NO: 438314 - DNA, 584 bp, Homo sapiens
  misc_feature: GZ8MTXP01BNCC8.44.36.D03.1.454.CMB.2.raw
  modified_base (223)..(223): a, c, t, g, unknown or other
  modified_base (310)..(310): a, c, t, g, unknown or other
  modified_base (360)..(360): a, c, t, g, unknown or other
  modified_base (399)..(399): a, c, t, g, unknown or other
  modified_base (494)..(494): a, c, t, g, unknown or other
  modified_base (521)..(521): a, c, t, g, unknown or other
  modified_base (532)..(532): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggatcaccatcagtgacccactatatggactggggtcccnccgagggcctccggagggggaagggggctgggagttggcttgggcccganaaggtaaaaaacaaggtttcgaccctaaaggtctttaanccaaacgaggacgtaccgcgcgttctgtagaaacgccaggacttccaaccctctacaagagatcgacttcaaagggtaacttcattgaatttcgngacaatcgaactaacctagaaaaccgnggaacacgggnagtagtattagttcgttagttgtcgtttaatatcgaggtaacttgtaacccg

SEQ ID NO: 438315 - DNA, 600 bp, Homo sapiens
  misc_feature: GZ8MTXP01D59XG.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccagccgtgggagggtccctgagactctcctgtgtcgctctggatcacatcagtgaccactatatggactgggtccgccaggctccgagggaggggctgggagtggcgttggccgacaaggtaaaaacaagttgacccaagtctttaagcaacagacgtacgccgcgtctgtagaaagccagtacttccaaccctctacaagagatagacttacaaaggtaacttctattgaattccgtgaccgtaaatcggtaaacctaaaccgtaacggaaaaccggaaggaaccacggggtacttagttaggttaatttgtttaggtttgttaagtttagtttaagtatcgttaagggtaacttcggtaacccg

SEQ ID NO: 438316 - DNA, 615 bp, Homo sapiens
  misc_feature: GZ8MTXP01BXLZV.44.36.D03.1.454.CMB.2.raw
  modified_base (321)..(321): a, c, t, g, unknown or other
  modified_base (602)..(602): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccagggaaggccctggagtggcttgcacacatcttctcgaatgacgaaaatcctacagtacatctctgaagagcagtttaaccatctccaaggacacctaccaaagcaggtgtctttagtatgaccaanatcggaccctgcggacaccaggcacatattaactgtgcgaacgggtaatggacggggaaaagaaacaagtcttagggttttctaggttaatttaagtaagttacctttaaccattccgtggaacgtcgtagggggacaaaggggggacctacgggttcaacccggttcctccgtccaggtaccctttcccgaaccgaaacggggcccctaagttcccgggtcccttcccccgtggcccgcccctgcccgttccgaggaaccgcaaccctggcgggggaccncgaacgccccggg

SEQ ID NO: 438317 - DNA, 688 bp, Homo sapiens
  misc_feature: GZ8MTXP01EOF26.44.36.D03.1.454.CMB.2.raw
  modified_base (344)..(344): a, c, t, g, unknown or other
  modified_base (391)..(391): a, c, t, g, unknown or other
  modified_base (435)..(435): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacattcttctacgaatagaaacgaaaatcctaacagtacatctctagaagagctaagtttaaccatcctaccaaggaccaccgtacaaaaggctaggtcgttactttagtatagacccaanagtcggaccctggaccgacaccgacggacaactattacttaaaccgngttcggacgtaacggggtaatacgggaacggggaaaagaaacgngtcgttggtttactaggttattaataagtttaccttacagttcgtaggtacgtcggtaggggacgaaacggggggccctacggggtaccacccggttctaccctcgacggtacccttacccgaacccggtaaaccgggtcccctaggttccccggttcccttccccccggtggccccgtcccgttcggcccgttcggaccgggtaacgcccaacccggttcgggcgggggaccaaccggaacgggtccccggg

SEQ ID NO: 438318 - DNA, 647 bp, Homo sapiens
  misc_feature: GZ8MTXP01B6TF5.44.36.D03.1.454.CMB.2.raw
  modified_base (303)..(303): a, c, t, g, unknown or other
  modified_base (340)..(340): a, c, t, g, unknown or other
  modified_base (368)..(368): a, c, t, g, unknown or other
  modified_base (462)..(462): a, c, t, g, unknown or other
  modified_base (584)..(584): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttggtccagcctggagggtccctgagactctcctgtgtcgcctctggattcaccatcagtgaccactatagtggactgggtccnccaggctccgagggagggctggagtggcttggccganaagtaaaacaagttcgaccagtctttancaaacagaacgtacgccgacgtcgtgtagaaacgcccagtacttcccaaccctcgtacaaaggaactatgaacctttacgaaaagtaaccttanaatttgggaattttccgtgaccgtaaatccgaaccttaaaacccgtaggaaaaaacccggtggaacccaaacgggggctaagttaggttaatttagtttggtgtttacggttagtttttaanacgttaacgaaagggtaaccttcggtacccttaacgggttccgggggaacccgtaaccggggg

SEQ ID NO: 438319 - DNA, 723 bp, Homo sapiens
  misc_feature: GZ8MTXP01AIX3M.44.36.D03.1.454.CMB.2.raw
  modified_base (316)..(316): a, c, t, g, unknown or other
  modified_base (391)..(391): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccaggccgtgggacggggtccctgagactctcctgtgtcgcctctggatcacatcagtgaccactatagtggactggggtcccnccaggctccgaggggagggctgggagtggcttggccgacaaaggtaaaaacaagttcgaccctaagtcctttaancaacgaggacgtaccgcgtcgtcgtagtaagaacgctagtaccttaccaccctactacgaaagacgtacgtacgtaaccttaacgaaacggttaactacgttaacgttacgtaacctttcgtaaggtaaaccgtaaacgtaccggtaaaaccccgttaaaaccggtaaaaccgggaaaaaccccgggaacgggaaaccggttaaaccggggtacttaaacgtttaaggtttaaacgttttaggttttacgggttttagggttttaaggttttacgttttaaacgttaacggttaacggttaaacggtttaacccgttaacgggtaaccccgg

SEQ ID NO: 438320 - DNA, 728 bp, Homo sapiens
  misc_feature: GZ8MTXP01BIEUD.44.36.D03.1.454.CMB.2.raw
  modified_base (447)..(447): a, c, t, g, unknown or other
  modified_base (587)..(587): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgttattttacgaaggtgtccagagtgaagtgcgtaggttggtgggaggtccgggggagtacgttggtccagccgtgggacgggtccctgacgtaccttctccgtgtcgtccgcctcgtggtactcaccatcagtcgaccactatagtcggacgttcggggtcccgccgaggcctaccggagggggtaacggggcgtaggggaggttcgggcgttcgggaccgaacgaaaacggtaaaaaacgtaaaggtttcgaccctaaagttcttttaanaccgaaacgtaaggacggtaccggccgtacgttcgtaggtaaggaaaacgcccaagttaccttaccccaaccccttctaaacgaagaagtactacgtaacctttacgaaacggtaacttactaagtttacgtactttcgngtaaccgtaaagttccgtaaacccttaaaccgaacggaaaaccccggaacggaacgttaaccggggtacttaagttaggttaattttagttggtttagtttcgtttagtttaatacgtacgaggttaaccttcggtaaccg

SEQ ID NO: 438321 - DNA, 569 bp, Homo sapiens
  misc_feature: GZ8MTXP01CIXEK.44.36.D03.1.454.CMB.2.raw
  modified_base (296)..(296): a, c, t, g, unknown or other
  modified_base (326)..(326): a, c, t, g, unknown or other
  modified_base (359)..(359): a, c, t, g, unknown or other
  modified_base (546)..(546): a, c, t, g, unknown or other
tcagacagtatatacacgaccggtgctcgatttagctgcgtcacgatctctcttgggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttagaaatataactgtctctgacaagtatacccacgtaaacccccaactcttcttangaagtacaatagccggcctgggctatttcncatcgcttctcacggctacaagtctggacaacncggcctcgtagtataactttctcggccctctgcctaggacacgaggcctactattatgctgctactatagtcggtcgggttacctaggtattagttcgggttacgttcgggacgggtacggggaccggtccgtaacggcccgttcgtacggttcaacgggccaacgggccttccggcccctggtccncctcgttcgtcccaacccttccc

SEQ ID NO: 438322 - DNA, 544 bp, Homo sapiens
  misc_feature: GZ8MTXP01APVW9.44.36.D03.1.454.CMB.2.raw
  modified_base (296)..(296): a, c, t, g, unknown or other
  modified_base (379)..(379): a, c, t, g, unknown or other
  modified_base (397)..(397): a, c, t, g, unknown or other
  modified_base (400)..(400): a, c, t, g, unknown or other
  modified_base (487)..(487): a, c, t, g, unknown or other
  modified_base (516)..(516): a, c, t, g, unknown or other
  modified_base (521)..(521): a, c, t, g, unknown or other
  modified_base (531)..(531): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctagggttttccttgttgttattttacaaggtgtccagagtgaagtgcagttggtggagcccgggggagacttggtccagccgtggagggtccctgagactctcctgtgtcgctctggatcaccatcagtgaccactatanggactgggtccgccaggctccgaggggaaggggctgggagtggcttggccgccaaggtaaaaacaagttgcccaagctttaancacagagtacgcgcgtcngtnaaagccagacttcaaccctctcaagagaatgacttcaagggaactcattgaattcgtgcgtaatgtaacctaacctagaaaacccgnggaacacggggacagtgtaattattgttnttgtntttaatactnaggaacttgtccc

SEQ ID NO: 438323 - DNA, 537 bp, Homo sapiens
  misc_feature: GZ8MTXP01CAMH3.44.36.D03.1.454.CMB.2.raw
  modified_base (358)..(358): a, c, t, g, unknown or other
  modified_base (369)..(369): a, c, t, g, unknown or other
  modified_base (372)..(372): a, c, t, g, unknown or other
  modified_base (412)..(412): a, c, t, g, unknown or other
  modified_base (446)..(446): a, c, t, g, unknown or other
  modified_base (473)..(473): a, c, t, g, unknown or other
  modified_base (479)..(479): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgctctggatcacatcagtgaccactatatggactgggtccgcaggctccgaggggaggggctggagtggcttggccgcaagtaaaacagttnccaagcttaancanagagtacgccgcgtctgtagaaagccagacttcacccctntcaagagatgacttcaaggtactcatttgattcngcgaatgactaaacctggaaaacccgnggaacncgggcagtgtatttagttgttgtttgtagtttaataatcgaaggtaacttgtaacccg

SEQ ID NO: 438324 - DNA, 588 bp, Homo sapiens
  misc_feature: GZ8MTXP01DPFDI.44.36.D03.1.454.CMB.2.raw
  modified_base (307)..(307): a, c, t, g, unknown or other
  modified_base (376)..(376): a, c, t, g, unknown or other
  modified_base (429)..(429): a, c, t, g, unknown or other
  modified_base (463)..(463): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttggtccagccgtggagggtccctgagactctcctgtgtcgcctctggatcaccatcagtgaccatatatggactgggtccnccaggctcgagggagggctggagtggcttggccgacaaaggtaaaaacaagttcgaccaagtctttaanacaacgagacgtaccgcgtcgtactagagaaacgcaagtacttacccaccctntacgaaagatatacgtaacttacgaaagtacttntaattcgtattcgagaacgtaaatcgtaacctaaacgtaacggaaaaccggaagaacgacggtattagttagttatttagttgttagttgttagtttaatagtacgaaggtaacttcggtaaccg

SEQ ID NO: 438325 - DNA, 601 bp, Homo sapiens
  misc_feature: GZ8MTXP01BLZTM.44.36.D03.1.454.CMB.2.raw
  modified_base (274)..(274): a, c, t, g, unknown or other
  modified_base (311)..(311): a, c, t, g, unknown or other
  modified_base (380)..(380): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccagccgtgggagggtccctgagctctcctgtgtcgctntggatcacatcagtgaccactatatggactgggtccnccaggctccgagggaggggctgggagtggcttggccgacaaaggtaaaaacagttgccaagtctttaancacagacgtaccgcgtcgtcgtagagaacgcgagtacttaccaccctcgtaacgaagagtatacgtaacttacgaaacgtaactatattagtacttcgtacgaacgtaacgtacgtaaaccgtaaaccgtaacggaaaaccggaacggaacgacgggtacttagtagttaattagtttggttgtttgttagtttaatagtacgaggtaacgttcgtaaccg

SEQ ID NO: 438326 - DNA, 587 bp, Homo sapiens
  misc_feature: GZ8MTXP01DEZEA.44.36.D03.1.454.CMB.2.raw
  modified_base (322)..(322): a, c, t, g, unknown or other
  modified_base (562)..(562): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctagaagagcagtttaaccatctaccaaggacacctacaaagcaggtgtctttagtatgaccaanatgaccctgcggacaccaggcacatattaactgtgcgaagggtaaatggacgggaaagaaacagtcttggtttactgtattataagtacttacatcgtggacgtgtagggacgaaagggggacccacggtccaccgtcctcctcgacgtacctccgaaccgaacgggcccctagttcccggttccctttcccccgcgggccctccccgtgcccgttccgaacggcgaccctccgtcgggngggggacccaacggcggtccccggg

SEQ ID NO: 438327 - DNA, 664 bp, Homo sapiens
  misc_feature: GZ8MTXP01AC83T.44.36.D03.1.454.CMB.2.raw
  modified_base (279)..(279): a, c, t, g, unknown or other
  modified_base (289)..(289): a, c, t, g, unknown or other
  modified_base (588)..(588): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttttccttgttgttattttacaaggtgtccagagtgaagtgcaggttggtgggaggtccgggggagacgttggtccagccgtgggacgggtccctgacgactctcctgtgtcgcctntggatcaccntcagtcgaccactatagtggacgtcgggtcccgccgacggcctaccggagggggaacgggggtctaggggaggtggcgttcgggacccgaacgtaaacggtaaaaaactaaggttcgacctaaagtaccttttaagcaaacgtaggtaacgtaccgccgtacgttactaggtaacgaaaacggtccctaaggtacctttaccaccccttataacgaaaggtagactacgtaacttacaaacgggtaactcgtattagaatttcgagaccgaattcgaaccttaaaccgacgaaaaccgnggaacgacgggtcttaagttgtaatttgttgttagtttggtatttaactatcggttaacgtaacttcggtaacccg

SEQ ID NO: 438328 - DNA, 590 bp, Homo sapiens
  misc_feature: GZ8MTXP01EVFGW.44.36.D03.1.454.CMB.2.raw
  modified_base (224)..(224): a, c, t, g, unknown or other
  modified_base (285)..(285): a, c, t, g, unknown or other
  modified_base (306)..(306): a, c, t, g, unknown or other
  modified_base (379)..(379): a, c, t, g, unknown or other
  modified_base (430)..(430): a, c, t, g, unknown or other
  modified_base (439)..(439): a, c, t, g, unknown or other
  modified_base (460)..(460): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctgggagggtccctgagactctcctgtgtcgctctggatcacatcagtnacactatatggactgggtccnccaggctcgaggggagggctgggagtggcttggccgacaaagtaaaaacaagttcgaccctaaagtctttaancaactaggacgtaccgccgcgtctagtagaaacgccagacttcaacccctntacaaaganatagtaactacaaacgtactntaattgattcgagacgtaaatcgtaaacctaaaccgtaacggaaaaccggcggaaacgacgggtacttagttagttaatttgtttgttgtttgttatttaacagtagttaacggtaacttcggtaacccg

SEQ ID NO: 438329 - DNA, 609 bp, Homo sapiens
  misc_feature: GZ8MTXP01AES2Y.44.36.D03.1.454.CMB.2.raw
  modified_base (205)..(205): a, c, t, g, unknown or other
  modified_base (587)..(587): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggaccccccggnagagggtcatcatctcttgttctggaagcagttccaacatcggcccttaattctgtatattggtaccagcaagtcccaggaaccgcccccaaactcctcatctataggactaatcagcgccctcgacggggtccctgaccgtattctccgtggctccaagtctggccaaccctcacgtccctcccctggcccattccgacggtcggggcccccggtcgagggacgtaggttcgatttactacgtgaccgcagtcgttaggggggactcggaccccggtccgtggcgggcctttgggcttggttccgggacggtaggggaacccaaacgtcgaccgtccgttaggtccaacggcccgacgggcctccggcccccgtcggtccncgttccgtcgttccccgtcccc

SEQ ID NO: 438330 - DNA, 650 bp, Homo sapiens
  misc_feature: GZ8MTXP01BFIXX.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctgggtggagtcgtgggggagcgttgggtacgagggcgggggggtccctgagactctcctgtgcagcctctggattcatcttcagtgactatgccatgaacgtgggtccgcgaggcctcgagggggagggctggagtggtttccatagtgtaatatgctggagactacccacctactacgcagacttcgtggtacggaaacggggtccctaatttacccaaaccgttaaagttccccggaaaggggtaacctaaacgttacggaaacccctaaaaggggtaaacccttccgtaaaccttacggttaaatccgttaaggaaaacttacggaaacgacgtacccgtaggaaggaacggaacggaggaaccgttacgggtcttacggttcctttacgttcgtaacggttcgaaggtacggtacgttcccggggtaaccttaacgtttggg

SEQ ID NO: 438331 - DNA, 610 bp, Homo sapiens
  misc_feature: GZ8MTXP01DS01D.44.36.D03.1.454.CMB.2.raw
  modified_base (273)..(273): a, c, t, g, unknown or other
  modified_base (310)..(310): a, c, t, g, unknown or other
  modified_base (414)..(414): a, c, t, g, unknown or other
  modified_base (435)..(435): a, c, t, g, unknown or other
  modified_base (587)..(587): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcagttggtgggaggtccggggagtacgttggtccagccgtgggaggtccctgagactctcctgtgtcgcctntgatcacatcagtgaccactatagtggactgggtccnccgaggctccgagggggagggctgggagtggctggccgagaagtaaaaaacagttcgacctaagtctttaagcacgagacgtacgccgtcgtctagtagaaacnccaagtacttccaaccccttntaccgaaagagacttagtaaccttacgaaaggtaaccttgtaaatttggtaacttccgtagaccgtaaaatcgtaaacctaaaccgtaacgaaaacccgaaggaacgacgggtattagttagttattagttgttagttgttacgttaattanacgttaggtaacttggtaacccg

SEQ ID NO: 438332 - DNA, 688 bp, Homo sapiens
  misc_feature: GZ8MTXP01ARKLR.44.36.D03.1.454.CMB.2.raw
  modified_base (217)..(217): a, c, t, g, unknown or other
  modified_base (302)..(302): a, c, t, g, unknown or other
  modified_base (368)..(368): a, c, t, g, unknown or other
  modified_base (417)..(417): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccnccaggctccgaggggaggggctggagtggcttggccgacaagtaaaaacaagttcgccagctttancaaacagcgtacgccgcgtctgtagaaacgcccagattccaaccccttntacgaaagacgatacgtaaccttacgaaaagtaacctctaattacgggtaactttccgtacggtaaaccgtaaattaccggtaaaacccttaaaacccggtaaacggaaaaaaccccgggtaggggaacccgtaaaccgggggtactaaaggtttgtttaaagtttacggtttggtttacggttttaggtttagttttaaagttaccgttaacgaaagggttaaccgttcggtaccccgttacgggtccggggggaaccccgtaacggggg

SEQ ID NO: 438333 - DNA, 721 bp, Homo sapiens
  misc_feature: GZ8MTXP01CFYD3.44.36.D03.1.454.CMB.2.raw
  modified_base (275)..(275): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgcttgggttttccttgttgcttattttagaaggtgtccactgtgaggtgcggctgggtggagtcgtgggggagtcgttggtacgagggcgggggggtccctggagactctcctgtgcagcctcnggattcatcttcagtgactatgccagtcgaacgtcgggtcccgccgaggcctccggagggggagggggctggagttggggtttcccagttagttagtttaaatagttcggtacgtgggaacgtaaacttacccctaaccctaaccgtacgacaacggtacttcgtaggtagggaaacggggtcctaactttaccgaacctaaattccccggaagggaaccaaagttcgaaccccaaagggtaacctcctaacgttagtaaccgttagtaacgggaaaattacggaaacctaaggtcccgtaagggaaacgggaaacggaaaccgggacggggtaaacccgaacggggttcttacggtttacccgtttaaacgttttccggttaacggtttaccggaaggttacgggtccggttacccgggggtaaccttaacggggttttccgggg

SEQ ID NO: 438334 - DNA, 714 bp, Homo sapiens
  misc_feature: GZ8MTXP01BWDAZ.44.36.D03.1.454.CMB.2.raw
  modified_base (440)..(440): a, c, t, g, unknown or other
  modified_base (473)..(473): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcaggttggtggaggtccgggggagacgttggtccagccgtgggagggtccctgacgactctcctgtgtcgcctcgtggatcaccatcagtcgacctatatagtggacgtggggtcccgccaagggcctccggaagggggaacgggggtctagggggagttgggctttggggacccgacaaaggtaaaaaacaaggtttcgaccctaaagtctttaagcaacgagtacgtaccgccgngttctgtagaaacgccagacttaccgacccctntacaaagagatacgtaacttcaaagggtaaccttcgtaatttggaaactttcgtacggtacgtaaactacggtaaacccttaaaacccgttaacggaaaaaaaccccggggaagggtaaacccgaacggggggtaaccttaaggtttacggttaaattttaacgtttgggtttagggttttaagtttaccgggtttttaataaccgtaggttaaacggtaaccgttcggtttaaccccggg

SEQ ID NO: 438335 - DNA, 589 bp, Homo sapiens
  misc_feature: GZ8MTXP01C4767.44.36.D03.1.454.CMB.2.raw
  modified_base (337)..(337): a, c, t, g, unknown or other
  modified_base (366)..(366): a, c, t, g, unknown or other
  modified_base (414)..(414): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagtggtggagtccggggagacttggtccagcctggagggtccctgagactctcctgtgtcgcctctggattcaccatcagtgaccactatatggactgggtccgccaggctccgaggggagggctggagtggctggccganaagtaaaacaagttcgacctagctttaancgaaacagcgtacgcgtcgtcgaggtacaaacgcatactccacctcanaagagtatacgactacaaatactatattagtattcgtagacgtaatacgtaaacctaaacgtaaacggaaaccgacggaacgacggtataagttgttattagttggtttagttgttagtttacttagtaacgtaagtaacgtcggtaccgttacgggtcggggaaccgtaacggg

SEQ ID NO: 438336 - DNA, 656 bp, Homo sapiens
  misc_feature: GZ8MTXP01BOVM8.44.36.D03.1.454.CMB.2.raw
  modified_base (276)..(276): a, c, t, g, unknown or other
  modified_base (409)..(409): a, c, t, g, unknown or other
  modified_base (466)..(466): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccagccgtggagggtccctgagactctcctgtcgtcgcctntggatcacatcagtcgaccactatagtggacgtcgggtcccgccgaggcctaccggagggggaacggggctgggaggtggcgttggacccgacaaaggtaaaaacaaaggttcgaccctaaagtccttttaanaccaacaggacgtaccgccgtcgtctagtagaaacgtccagtacttcccaacccctntacgaagagtatacgtaacttaccgaaaggtaaccttctaattagtactttccgtagacgtaaattccgtaaaccttaaaccgtaggaaaaaccccggaaggaacgttacggggacttaggttagttaattttagtttggttgtttaaggttattttaatacgtacgttaacggtaacttcggtaacccg

SEQ ID NO: 438337 - DNA, 560 bp, Homo sapiens
  misc_feature: GZ8MTXP01EW8U4.44.36.D03.1.454.CMB.2.raw
  modified_base (219)..(219): a, c, t, g, unknown or other
  modified_base (264)..(264): a, c, t, g, unknown or other
  modified_base (304)..(304): a, c, t, g, unknown or other
  modified_base (343)..(343): a, c, t, g, unknown or other
  modified_base (371)..(371): a, c, t, g, unknown or other
  modified_base (378)..(378): a, c, t, g, unknown or other
  modified_base (416)..(416): a, c, t, g, unknown or other
  modified_base (432)..(432): a, c, t, g, unknown or other
  modified_base (450)..(450): a, c, t, g, unknown or other
  modified_base (478)..(478): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacttggtccagcctgggaggtccctgagctctcctgtgtcgcctntggattcaccatcagtgaccactatatggactgggtcccnccaggctccgaggggagggctgggagtggcttgggccanaagtaaaaacaagttcgccagtctttancaacagngtacgccgcgtctgtagaaagcccagacttccaccctntacaagagatgacttnaagactcattggatttcngacaatcgaacttaaccgagaaaaccgngaccacgggcaagttgttattagtttgtgttgttgtttacattcagggtaaccttggtccacggttcggggcccgtaacggg

SEQ ID NO: 438338 - DNA, 710 bp, Homo sapiens
  misc_feature: GZ8MTXP01EWKV2.44.36.D03.1.454.CMB.2.raw
  modified_base (340)..(340): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcccgtggagtggcttgcacacatcttctacgaatagaacgaaaaactcctaacagtacatctctagaagagactagttaaccatctacaagacacctacaaagcaggtgtcttagtatacgaccaacagtcgaccngacgacaccagcatatataacgtgtgacgaacgggtaaagtacggaacgggaaaacgaaacgacggtcgttagggtttactagttaaagttaataacgtttaccttacctagttcgtacgggtacgttcggtacgggggaacgaaaccggggggcccgtaaccggtaccgtaccccgtccttcccgtacgtaccgtaccccgttaacccaacccggtaaccggggtccccctaacggttccccgggtttacccccttcccccgggtcggttccccgtaccccgtcgaccccgttccggaacggtaacccggtccctaaccccggttccggggtaccgggggaccctaaccggaaccggggtcccccgggg

SEQ ID NO: 438339 - DNA, 724 bp, Homo sapiens
  misc_feature: GZ8MTXP01AKR5B.44.36.D03.1.454.CMB.2.raw
  modified_base (276)..(276): a, c, t, g, unknown or other
  modified_base (290)..(290): a, c, t, g, unknown or other
  modified_base (312)..(312): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacttgggtccagcccgtggagggtccctgacgactctcctgtgtcgctntgatcacatcagtnaccatatatggactgggtcccncaggcctccggaggggacggggctggggagtgggtcttgggcccgaagtaaacggtaaaaaacaaggttcgaccctaaagtcttttaagcaaccgagggacgttaccgccgtacgtcttaggacgaaaacgcccgtaagtaccttcccgaaccccttactaccgaaaagagtaactcggtaaacctttaccgaaaacgtaaccttctaagtttacggtaaacttttccgaggtaacccgtaaagttaccggtaaaaccccttaaaccccgtaaaagggaaaaaaccccgggtaagggaaaccccgagggggtaacccttaaagtttagggtttaattttaagttttggtttaggtttaagttacggttttttaaagacgttacggttaacggttaaccgtttcggaacccgg

SEQ ID NO: 438340 - DNA, 803 bp, Homo sapiens
  misc_feature: GZ8MTXP01CS9S8.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggactccgtcacgccccccgagggaacggccctggagtggcttgcacacatcttctacgaatgaacgaaatacctacaagtactactactctagaagagtactaacgtttaaacctaactacctaccaacgaaccgaacctaaacccgaaacggaacgtaggtacggttacgtttaagtatacgaaccaacgtaacgtacggaccgtacgacgaccgaacccgaggacactaatacttaacgttacgtcgacgtaaaccgggtaaaggttacgggaaccgggaaaagggaaaacgtaacggtacgttttcggtttacgtttaacggttatttaaacgtttaaacgttaaccgttttaaccgttaacgtacgttcgggtaaccggttcgggtaacgggggtaaccgggtaaaacgggggtaaaccccgttaccggggttaccccgtacccgtttacccgttccctaccgtaaccggttacccttaacccgtaaccccggaaccgggtaaccccgtccgttaacccggtccccgtttcccccggttcggccccgtccccgtcgcccgttacggaccgggaacgtaccccgtcccgtcggtcgggggcctaaccgggccggtcccgggg

SEQ ID NO: 438341 - DNA, 630 bp, Homo sapiens
  misc_feature: GZ8MTXP01BYC0T.44.36.D03.1.454.CMB.2.raw
  modified_base (315)..(315): a, c, t, g, unknown or other
  modified_base (388)..(388): a, c, t, g, unknown or other
  modified_base (439)..(439): a, c, t, g, unknown or other
  modified_base (447)..(447): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccaggccgtgggacgggtccctgacgactctcctgtcgtcgcctgtggatcacatcagtcgaccatatatggactggtccncgaggctccgaggggagggctgggagtggcttgggccacgaaagtaaaaacgaagttcgaccaagtctttaancaacgagacgtaccgcgtcgtctagtagaaacgccagtacttccgaccctntacaaagngtatacgtaacttacgaaaggtaaccttcgtaattggtaactttcgtagacgtaaacgtcgtaaaccctaaaccgtaagggaaaaacccggtcgggaaccgaacggggtacttaaggttagttaatttagttggttagtttgttagtttaatagtccgttaaagggtaaccttgtaaccccgg

SEQ ID NO: 438342 - DNA, 692 bp, Homo sapiens
  misc_feature: GZ8MTXP01CU7P9.44.36.D03.1.454.CMB.2.raw
  modified_base (278)..(278): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggagtccgggggagacttggtccagccgtgggagggtccctgagctctcctgtgtcgctctggatcacntcagtgacactatatggactcgggtccgccgagggcctccggagggggaaacgggggctgggaggtggcgttgggacccgactaaaggtaaaaaaacgaaggttcgacctaaagtcttttaagacaacgaaggacgtaccgcccgtcgtctagtagaaaacgtcccaagtacttacccaaccctctacaaagagaacttgaaacttacgaaagtaaacccttctaaagtttgaaactttccgtagacgtaaaagtcgtaaaccctaaacccgtaacggaaaaaaaccccgggtaagggaaacccgaaccgggggtaacaaggtttaacggttaaattttaaggtttggttaggttttaagttaggtttttaaccgtaatttccggaaaggggttaaaccttcggttaaccccgg

SEQ ID NO: 438343 - DNA, 563 bp, Homo sapiens
  misc_feature: GZ8MTXP01EF0F0.44.36.D03.1.454.CMB.2.raw
  modified_base (217)..(217): a, c, t, g, unknown or other
  modified_base (260)..(260): a, c, t, g, unknown or other
  modified_base (281)..(281): a, c, t, g, unknown or other
  modified_base (302)..(302): a, c, t, g, unknown or other
  modified_base (372)..(372): a, c, t, g, unknown or other
  modified_base (380)..(380): a, c, t, g, unknown or other
  modified_base (389)..(389): a, c, t, g, unknown or other
  modified_base (393)..(393): a, c, t, g, unknown or other
  modified_base (447)..(447): a, c, t, g, unknown or other
  modified_base (489)..(489): a, c, t, g, unknown or other
  modified_base (496)..(496): a, c, t, g, unknown or other
  modified_base (523)..(523): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctcctgtgtcncctctggattcaccatcagtnaccatatatggactgggtccnccaggctccgaggggaagggctgggagtgggcttgggccgacaagtaaaaacaagttcgaccagctttancaaacagngtacgccgngtcngtacgaaagcccaagattccaccctctacaaagagtatgacttcaaagacctanattgggaatttcgtgacgaatgaaccttaacaggaaaaccgngacaggntaatgttattagttgtgttgttatttnttactgaagtaactcgtacgacggtcgggaaccgaacggg

SEQ ID NO: 438344 - DNA, 813 bp, Homo sapiens
  misc_feature: GZ8MTXP01DYEO0.44.36.D03.1.454.CMB.2.raw
  modified_base (216)..(216): a, c, t, g, unknown or other
  modified_base (225)..(225): a, c, t, g, unknown or other
  modified_base (233)..(233): a, c, t, g, unknown or other
  modified_base (416)..(416): a, c, t, g, unknown or other
  modified_base (731)..(731): a, c, t, g, unknown or other
tcagacagtatatacacgaccggtgctcgatttagctgcgtcacgatctctcttggggagagcggagccccagccccagaattcccaggtgttttcatttggtgatcagcactgaacacagaggactcaccatggagttcgggctgagtctgggttttccttgttgttatttacaaggtgtccagagtgaagtgcaggttggtggagtccgggganactggtccnggcctggngggtccctgagctctcctgtgtcgcctctggacttcaccgtatcagtgaccctatatatcggacgtcgggtccgccgagggcctaccggaagggggtaagggggccgttagggaggtcgggtctttcgggacccgaacaaaggtaaaaaaacctaaggtttcgacccctagtacctttttaancccgaaaacgtaacggtaacggttaacccggcccggtacggttacccgttaggtttaacgggaaaacctccccgtaaggtaaacttttaccccgaaccccttacttaaccgaaagtaaccggtaattacggtaaacctttacgaaaacgttaacccttgtaactttagggggtactttaaccgtgtaaccggtaaattacgaaaccgttaaacccgtaacgggaaaaacccgtacgggaaccgtaaccgggggtctaaaggtttagttaaagtttaagtttttaccggtggtttaaggttaaaggtttttaaccngtttaaccgtaacgggttaaacccgttcggggtaccccgttaacgggtttaaccccggggggaacccgtttaaacccggggg

SEQ ID NO: 438345 - DNA, 639 bp, Homo sapiens
  misc_feature: GZ8MTXP01E0MX4.44.36.D03.1.454.CMB.2.raw
  modified_base (345)..(345): a, c, t, g, unknown or other
  modified_base (374)..(374): a, c, t, g, unknown or other
  modified_base (523)..(523): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacttggtccagcctgggagggtccctgagactctcctgtgtcgcctctggattcaccatcagtgaccatatagtggactgggtccgcaggctccgaggggaggggctgggagtggcttgggccganaagtaaaaacaagttcgaccagtctttancaacagaagtaccgccgtacgtctgtacgaaacgccagtacttacccacccgttctacgaaagagtaattcggaaccttacaaacgtaacctctaagtttggatttccgtagacgtaaatacgtaaacctaaccgtaaggaaaacccgnggaaccgacgggtctaagttgtttaaagttctttggttcgtttaggttagtttttaacagttaaccgaagggttaacctggtcccgttaacggtcgggggaacccgtaaccggggg

SEQ ID NO: 438346 - DNA, 612 bp, Homo sapiens
  misc_feature: GZ8MTXP01D4CFM.44.36.D03.1.454.CMB.2.raw
  modified_base (219)..(219): a, c, t, g, unknown or other
  modified_base (282)..(282): a, c, t, g, unknown or other
  modified_base (304)..(304): a, c, t, g, unknown or other
  modified_base (344)..(344): a, c, t, g, unknown or other
  modified_base (375)..(375): a, c, t, g, unknown or other
  modified_base (422)..(422): a, c, t, g, unknown or other
  modified_base (424)..(424): a, c, t, g, unknown or other
  modified_base (429)..(429): a, c, t, g, unknown or other
  modified_base (433)..(433): a, c, t, g, unknown or other
  modified_base (438)..(438): a, c, t, g, unknown or other
  modified_base (446)..(446): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacttggtccagccgtgggagggtccctgagctctcctgtgtcgcctctggattcacatcagtnaccactatatggactgggtccnccaggctcgaggggaagggctgggagtggcttgggccganaaagtaaaaacaagttcgacctagtctttancaaacagcgtacgccgcgtctgtagaaagccagtacttccaccctananaaganatanactanaaatactntattgtattcgagacgtaatacgtaaacctaaaccgaaacggaaaaccggtacggaacgacgggtataagttgttatttagtttggttagtttagttagtttacttagtaacggaaacggtaacgttcggtaccggttacgggtaaccggggaacccgtaacgggg

SEQ ID NO: 438347 - DNA, 813 bp, Homo sapiens
  misc_feature: GZ8MTXP01CLN4H.44.36.D03.1.454.CMB.2.raw
  modified_base (422)..(422): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcgtaggttggtgggaggtccgggggagtacgttggtccaggccgtgggacgggtccctggacgtaccttctcctgtgtccgcctcgtggactcaccatcagtcgaccactatagtggtacgtcgggtcccgcgaggccgtccggagggggtaagggggctggggagtggcgttgggaccgactaaaggtaaaaacaaggttcgacctaagttactttaancaacgaggacgtaccgccgtcgtactgtaagaaacgccaagtaccttacccaccccttactacgaaagggtactaacgtacggtaacctttaacgaaaacggttaacctttaccgttaagttttacggtaaactttccgtaacggtaaaccgttaaaacgttaccgggtaaaaaccccttaaaaccccggttaaacggggaaaaaaaacccccggggtaacgggtaaaacccggaaccccggggggttaacttaaacggtttttaacgggttttaaagtttttaaaggtttttggggttttaacggggttttttaagtttacgttttttaaacgttaaaggttaccgggttaaaacgggtttaaacccgtttcggggtttaaccccccggg

SEQ ID NO: 438348 - DNA, 592 bp, Homo sapiens
  misc_feature: GZ8MTXP01CGDPO.44.36.D03.1.454.CMB.2.raw
  modified_base (317)..(317): a, c, t, g, unknown or other
  modified_base (389)..(389): a, c, t, g, unknown or other
  modified_base (436)..(436): a, c, t, g, unknown or other
  modified_base (461)..(461): a, c, t, g, unknown or other
  modified_base (474)..(474): a, c, t, g, unknown or other
  modified_base (514)..(514): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtgggaggtccgggggagtacgttggtccaggccgtgggacgggtccctgagactctcctgtgtcgcctctggatcacatcagtgaccatatagtggactgggtccnccaggctccgagggggagggctgggagtggcttggaccgacaagtaaaaacagttcgacctaagtctttaanacaacgagtacgaccgcgcgtctgtagaacgcagtactccacctcanaagagatacgtactacgaagtactntattagtattcgngaacgtaactacgtaaacctaaaccgaacggaaaaccggnggaaccgacgggtacttagttagttaatttagttgttagtttgttagtttaatagtacgaaggtaacttcggtaaccg

SEQ ID NO: 438349 - DNA, 646 bp, Homo sapiens
  misc_feature: GZ8MTXP01DYDNC.44.36.D03.1.454.CMB.2.raw
  modified_base (327)..(327): a, c, t, g, unknown or other
  modified_base (339)..(339): a, c, t, g, unknown or other
  modified_base (408)..(408): a, c, t, g, unknown or other
  modified_base (456)..(456): a, c, t, g, unknown or other
  modified_base (488)..(488): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtgggagggtccgggggagtacgttgggtccaggcccgtggggacggggttcccctggacgtaccttcctcccgttggtcgtccgccctcgtggattcaccatcagtgaccatatanggactgggtccncaggctcgagggggagggctgggagtggctggccgacaaagtaaaaacagttcgacctaagtctttaancaagagacgtacgcgtcgtctgtagaaacgccagtacttccacccttnacaaggacatacgacttacgaaaggtaacctntaattcggtacttcgtagacgtaaactcggtaaaccctaaacgtaacgggaaaaccggaagggtaaccgacggggtaccttaagtagttaatttagtttggttaggtttaagttagtttaacttaagtccgttaagggttaaccttggttaaccccgg

SEQ ID NO: 438350 - DNA, 634 bp, Homo sapiens
  misc_feature: GZ8MTXP01DL2B8.44.36.D03.1.454.CMB.2.raw
  modified_base (392)..(392): a, c, t, g, unknown or other
  modified_base (396)..(396): a, c, t, g, unknown or other
  modified_base (442)..(442): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagagtactcaccatggagttcgggctgagcttgggttttccttgtttgtttattttacaaggtgtccagagtgaagtgcaggttggtgggaggtccgggggagacgttggtccagccgtggaggtccctgagctctcctgtgtcgctctggatcacatcagtgaccactatatggactcgggtccgccgacggctccgagggggaagggggctgggagtggcgttggccgacaaagtaaaaaacaagttcgaccaagtactttaanacanagacgtaccgccgcgtctgtagaaacgccagtacttccaccccttntacaagagatacgaacttacgaaaggtaaccttctaatttagatttccgtagacgtaaaactcggtaaacccttaaaaccgtaacggaaaaaacccggaagggaaccggacggggtacttaaagttaggtttaatttagtttggttaggttttgttagtttaactatacgaagggtaacgttcgtaaccccg

SEQ ID NO: 438351 - DNA, 547 bp, Homo sapiens
  misc_feature: GZ8MTXP01AJ8ID.44.36.D03.1.454.CMB.2.raw
  modified_base (192)..(192): a, c, t, g, unknown or other
  modified_base (371)..(371): a, c, t, g, unknown or other
  modified_base (396)..(396): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggatcaacatcatccaggtaaacgcccccaaatcatcatctatgaggcctagtaagagccctcgaggggtttctaactcgtcttcactcgaccctccaagtccgcaacnccggcctcctgacatctctggctcnggctgaggacgagctagatttatagttgttgctacgtagtatcgttacgtcgctatctacttatgtcgttgggaacgttcgggaaccgtagggttccgaccgttccgtaaggtaccaacggcccaacggacccctaacccgttcttaaccg

SEQ ID NO: 438352 - DNA, 596 bp, Homo sapiens
  misc_feature: GZ8MTXP01DELIJ.44.36.D03.1.454.CMB.2.raw
  modified_base (293)..(293): a, c, t, g, unknown or other
  modified_base (305)..(305): a, c, t, g, unknown or other
  modified_base (446)..(446): a, c, t, g, unknown or other
  modified_base (526)..(526): a, c, t, g, unknown or other
  modified_base (532)..(532): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccgggggagacttggtccagcctggaggtccctgagactctcctgtgtcgctctggatcaccatcagtgaccatatanggactgggtccnccaggctccgaggggaagggctgggagtggcttgggaccgacaaaggtaaaaaacaagttcgaccctaaagtcttttaagcaaacgaggacgtaccgccggcgttctaggtagaaacggccaagtacttaccaaccccttntacaaagagatgacttacaaaggtactcaattgaattccgtagacgtaaatcgtaaaccttaaaccgagaaaaacccggnggaacngggacagttgtaatttagttggttagtttcgttagtttaatagtcgaggtaaccttgtaacccg

SEQ ID NO: 438353 - DNA, 683 bp, Homo sapiens
  misc_feature: GZ8MTXP01BJXIT.44.36.D03.1.454.CMB.2.raw
  modified_base (517)..(517): a, c, t, g, unknown or other
  modified_base (592)..(592): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagtccgtgggagggtccctgacgactctcctgtgtcgcctctggatcaccatcagtcgaccactatagtggacgtcgggtcccgcgacggcctccggagggggagggggcgtgggaggtggtcgttggccgacgaaaggtaaaaaacgtaagttcgaccctaaagtctttaagtcacgaaggtacgtacgccgtcgtcgtaggtacgaaaacgtcccaagtacctttacccaaccccttgtaccaaaggactattacggaactttaccgaaaaggtaaccctntaaagtttcgtaatttcccgtaggtaccgtaaatacggtaaacccttaaaaccggtaacgggaaaaaaccccggngggaaacccgaacgggtacttagttaggtaatttagtttggttagttttcgttagtttaatacgtcgttaacgggtaacttcggtaacccg

SEQ ID NO: 438354 - DNA, 655 bp, Homo sapiens
  misc_feature: GZ8MTXP01COSC8.44.36.D03.1.454.CMB.2.raw
  modified_base (351)..(351): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatagaacgaaaatcctaacagtacattctctagaagagactaacgtttaaccaatcctaccaaacggaaccaccctaaccaaaaggctaaggtggttactttagtatcgaaccaanatcggaccctgacgacaaccgacggacacatattaactgtcgacgtaacggggtaatagggaacgggaaaagaaacgtagcgtttggttacttagtaattaacttagttacttaacctatccgtagacgtcgtaggggaacaaagggggcccaacgggtccaccgttctccctcgacgtccctacgaacccgaacgggtcccctacgtcccggttcccttcccccggtggcccgtccccgtacgttccccgttcgacgggtaacgcccgaaccgttcgggacggggccaacggccgggcccggg

SEQ ID NO: 438355 - DNA, 633 bp, Homo sapiens
  misc_feature: GZ8MTXP01D2WK0.44.36.D03.1.454.CMB.2.raw
  modified_base (287)..(287): a, c, t, g, unknown or other
  modified_base (380)..(380): a, c, t, g, unknown or other
  modified_base (399)..(399): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctctggatcaccatcagtnaccactatatggactcgggtccgccaggctccgagggggagggctgggagtggctggccgacaagtaaaaacaagttgacccaagtctttaancaacgagacgtaccgccgngtctagtagaaagcccaagtacttcccgaaccccttctaaccaaagagactgaaccttacgaaaaggtaactctaatttagaatttccgagaccgtaaaatcgtaaacccttaaaccgtaacggaaaaaacccggtaaggaaccgaaaccgggggtcttaaagttggttaaattttagtttggttagttttgttagttttaatataccgttaagggtaaccttcggtaaccccg

SEQ ID NO: 438356 - DNA, 701 bp, Homo sapiens
  misc_feature: GZ8MTXP01CTGSN.44.36.D03.1.454.CMB.2.raw
  modified_base (257)..(257): a, c, t, g, unknown or other
  modified_base (262)..(262): a, c, t, g, unknown or other
  modified_base (267)..(267): a, c, t, g, unknown or other
  modified_base (280)..(280): a, c, t, g, unknown or other
  modified_base (285)..(285): a, c, t, g, unknown or other
  modified_base (302)..(302): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgctgggttttccttgttgctattttagagtgtccactgtgaggtgcggctggtggagtcgtgggggaggcgttggtacgaggcggggggggtcctggagactctcngtgcngcctngatcatctcagtnactangcatgacgtgggtcccncgaggcctccggagggggaggggcgtgggtaggttgggtttacattagttgttaaatagttgcgtggagaacttaacccgacctactacgacagtaccttcgtggtacggaaacgggtcctaattaccgaaccctaaagttccccggaaagggaacctaagtacgaacccgaaaacgggtaacccttcgtaaaccgttaggttaacttaccggtaaagggtaaaattacggaaaccctaaggtaccccgtagggaaacggaacggtaaacccggggacgggtaaacccgttaacccgggggtctttacggttacccttttaaccgtttcgtttaaccgggtttaacgaacgggtacggtaccggttcccgggggtaacccctttaagggttttccgggg

SEQ ID NO: 438357 - DNA, 604 bp, Homo sapiens
  misc_feature: GZ8MTXP01E082D.44.36.D03.1.454.CMB.2.raw
  modified_base (213)..(213): a, c, t, g, unknown or other
  modified_base (256)..(256): a, c, t, g, unknown or other
  modified_base (294)..(294): a, c, t, g, unknown or other
  modified_base (359)..(359): a, c, t, g, unknown or other
  modified_base (407)..(407): a, c, t, g, unknown or other
  modified_base (426)..(426): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtggtttcctgttgttatttacaaggtgtccagagtgaagtgcagttggtggagtccgggganacttggccagcctggaggtccctgagctctcctgtgtcgcctntggattcaccatcagtgaccatatatggactgggtccncaggctccgaggggagggctggagtggcttggccgacaaggtaaaaacagttcgccagtctttancaacagcgtacgccgagtctagtgaaacgccaagtcttccaccccttnacgaagtagatacgactanaaacgtactctaattcggtactttcgagaacgtaaatcgaaaccttaaaccgtaaacggaaaaccgaggaaccgacgggtataagttagttaaatttagttaggttagtttagttacgtttaattacgtaacgtaaggtaacttcggacccgttacgggtcggggaacccgtaacggg

SEQ ID NO: 438358 - DNA, 644 bp, Homo sapiens
  misc_feature: GZ8MTXP01EE8Z9.44.36.D03.1.454.CMB.2.raw
  modified_base (310)..(310): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagcctggacgggtccctgagactctcctgtgtcgcctctggatcacatcagtgaccactatatggactggtccnccaggctccgaggggagggctgggagtcggcgttggccgacaaggtaaaaaacaagttcgacccaagtctttaatcaacaacggagtaccgccgcgttctaggtagaaacgccgagtacttccaaccccttctacaaagganaacgtgtaactttaccgaaagggtaaaccttgtaaatttcgtacttacgtagtaacgtaaacgtacgtaaaccgtaaaccgtaaacggaaaaaccggaacgggaaccgaacgggtacttaagttagttaatttagtttcggtttaggtttaagtttagtttaactagtacggttaacgtaacgttcgtaacg

SEQ ID NO: 438359 - DNA, 568 bp, Homo sapiens
  misc_feature: GZ8MTXP01ECOAG.44.36.D03.1.454.CMB.2.raw
  modified_base (273)..(273): a, c, t, g, unknown or other
  modified_base (380)..(380): a, c, t, g, unknown or other
  modified_base (430)..(430): a, c, t, g, unknown or other
  modified_base (505)..(505): a, c, t, g, unknown or other
tcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagccgtggagggtccctgagactctcctgtgtcgcctntgatcacatcagtgaccatatatggactggtccgccaggctccgaggggagggctgggagtggcgttggccgacaaagtaaaaacaagttcgacctaagtctttaancaacgagacgtaccgccgcgtctagtagaaacgccagtacttccaccctntacaagagatagtaacttacaaacggtaactctattcgattctgacgtaatcgtaacctaacgtagaaaacccgngacagggcagtgttaatttgttgttgttgttagtttaatactgttaaggtaacttgtaacccg

SEQ ID NO: 438360 - DNA, 607 bp, Homo sapiens
  misc_feature: GZ8MTXP01D7FV3.44.36.D03.1.454.CMB.2.raw
  modified_base (261)..(261): a, c, t, g, unknown or other
  modified_base (300)..(300): a, c, t, g, unknown or other
  modified_base (356)..(356): a, c, t, g, unknown or other
  modified_base (368)..(368): a, c, t, g, unknown or other
  modified_base (422)..(422): a, c, t, g, unknown or other
  modified_base (506)..(506): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccggggagacttggtccagcctggagggtccctgagctctcctgtgtcgcctntggattcaccatcagtgaccactatatggactgggtccncaggctcgaggggagggctgggagtggcttgggaccgacaagtaaaaacaagttcncctagtctttancaaacgagaacgtacgcccgtcgtctgtagaaacgcccaagtacttccaccctntacaaggactatgaacttcgaaaagtactactatttggaatttcgtagacgtaaattcgaaccttaaaccgaaggaaaacccgngggaaccacggggactaagttgttaattagtttggtgtttgttagttttattagtcgtaaaggtaacttggtacccaggttcggggaacccgtaaccgggg

SEQ ID NO: 438361 - DNA, 719 bp, Homo sapiens
  misc_feature: GZ8MTXP01CEK0I.44.36.D03.1.454.CMB.2.raw
  modified_base (672)..(672): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaagtgggtgtgagctggatccgtcacgcccccgagggaacgccgtggagtggcttgcacacatcttctacgaatagaaacgaaaatcctaacagtacatctactagaagagactaacgttaaaccactctaccaacggaaccaacctaaccgaaaaggcgtagggttaggtactttaagtactacgaaccaacagtacggacccgtaggaccgacaccgaggacaactaatacttaacgtgtgacggtaaacgggtaaagtacgggaaacgggaaacgaaacgacggtactttagggtttacttaaggttaatttaagttaacgttacctttaaccgtagttcggtacgggacgttacggtaggggaaaccgaaacggggggaccgtaaccggtaccacccggttcctccgtccaacggtaccctacccgaaccggaacggcccctacgttccccgggtacccttcccccgggtacgccccgtacccgtcgccccgttcgaacgggccncccgtaacccggttcggaccgggggacctaaccgccgggtccccggg

SEQ ID NO: 438362 - DNA, 613 bp, Homo sapiens
  misc_feature: GZ8MTXP01ARZTG.44.36.D03.1.454.CMB.2.raw
  modified_base (274)..(274): a, c, t, g, unknown or other
  modified_base (398)..(398): a, c, t, g, unknown or other
  modified_base (456)..(456): a, c, t, g, unknown or other
  modified_base (586)..(586): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccagccgtgggacgggtccctgagactctctgtgtcgcctntggatcaccatcagtgacccactatagtggactcggggtcccgccaggcctccggagggggaagggggctgggagtggcttgggccgacaaaggtaaaaacaagttcgcccaaagtcttttaancaacgtagacgtaccgccgtcgtctaggtagaaacgccaagtacttcccgaacccctntacaaggatatcgacttacaacggtactcattagattcagacgtaatcgaaacctaaaccgtagaaaacccggaaggaaccgacggggacttagtagttaattagtttggttgtttaagttagttttaanattcgaacggtaacgttcggtaacccg

SEQ ID NO: 438363 - DNA, 700 bp, Homo sapiens
  misc_feature: GZ8MTXP01BZ5SD.44.36.D03.1.454.CMB.2.raw
  modified_base (405)..(405): a, c, t, g, unknown or other
  modified_base (465)..(465): a, c, t, g, unknown or other
  modified_base (474)..(474): a, c, t, g, unknown or other
  modified_base (507)..(507): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagccgtggacgggtccctgagactctcctgtgtcgcctctggactcacatcagtcgaccactatagtcggacgtcggggtcccgccgacggcctccggagggggaacgggggtctgggaggtggcttggaccgacaaagtaaaaacgaagttcgacctaagtctttaanacacgagacgtaccgccggtcgtctaggtacgaaacgccagtaccttcccaaccccgttntacgaaagngactacgtaacttaccaaagggtaaccctttanaagtttcgaactttccgaaggtaccgtaaagttacgtaaacccttaaaacccggtaacgggaaaaaaacccggaacggggaaaccgaacggggtcttaaagttacggtttaaatttggtttggttagttttaacgggtttatttaaaccgtttataccggttaaacgggttaacccgttcgggttaaccccgg

SEQ ID NO: 438364 - DNA, 668 bp, Homo sapiens
  misc_feature: GZ8MTXP01CTMZW.44.36.D03.1.454.CMB.2.raw
  modified_base (405)..(405): a, c, t, g, unknown or other
  modified_base (463)..(463): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagtcttgggttttccttgttgttattttacaaggtgtccagagtgaagtgctaggttggtggaggtccgggggagtacgttggtccaggccgtgggacggtccctgagctctcctgtcgtcgcctctggacttcaccatcagtcgaccctatatagtggaccgtgggtcccgccgaggcctacggagggggaaggggcgtgggagtcgggcgttgggccgaacgtaaagtaaaaacaaggttccgacctagtctttancaaacgagaacgtaccgccgtcgtcgtagtagaaacgccaagtacttaccaccccgtntacgaaagacgtatgtaaccttacaaacgtaaccttctaagtttacggtaactttcgtagacgtaaataccggaaaccttaaacccgaaagggaaaacccgtaggaaccgaacgggtctaagttagttatttagttggtttagttgttagtttattagtaacgtaaggtaacttggtacccgaggtccggggaaccgtaaccggg

SEQ ID NO: 438365 - DNA, 637 bp, Homo sapiens
  misc_feature: GZ8MTXP01CACLT.44.36.D03.1.454.CMB.2.raw
  modified_base (428)..(428): a, c, t, g, unknown or other
  modified_base (492)..(492): a, c, t, g, unknown or other
  modified_base (500)..(500): a, c, t, g, unknown or other
  modified_base (571)..(571): a, c, t, g, unknown or other
  modified_base (585)..(585): a, c, t, g, unknown or other
  modified_base (616)..(616): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcgagttggtgggaggtccgggggagacgttggtccaggcccgtgggacgggtccctgacgactctcctgtgtccgcctctggatcaccatcagtcgaccactatagtggacgtgggtcccgccgagggcctaccggagggggaacgggggctgggggagtcgggcgttggggacccgaccgtaaaggtaaaaaaccaaaggtttcgaccctaaagttccttttaanccaacgagggtacgtaccggcccggtcgtccgtagtacgaaacgcccaagtacttccacccctntacaaganatcgacttacaaaggtacttctattgattcgagacgtaaatcgtaaacctaaccgtaacggaaaacccggnggtaaccacggggnagttgttattagttgttgtttgtactttaantacgagtaacgttcgtaaccg

SEQ ID NO: 438366 - DNA, 832 bp, Homo sapiens
  misc_feature: GZ8MTXP01C5D9B.44.36.D03.1.454.CMB.2.raw
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgtttatttacaaggtgtccagagtgaagtgctaggttgggtgggacggtccgggggagtacgttcggtccacggtccgtgggacggtcctgagtcctctccgtgtcgtccgtcctgtggtacttccacctatcgagtacacctatatagtcggacgtcgggtcccgaccgacggtccgtaccgggaagggggtaacgggggtcgtagggggacggttcgggtccggttccgggggacccgtaaacgtaaaaaacgggttaaaaaaaaccgttaaacgggtttccccggaaccccgtaaggtttacccttttaacgaacccgtaaaaccgtaaacggtaacgggtaccccgggcccgggtacggtttccgtaagggtaaacgaaacggaccctaagttaccttccccctaaccctgtaaaccgaaaggagtacttacgtaaccttaacaaaacgtaccttagtagtttaggtaactttccggagtaaccgtaagtaaccgtaaaccctaaacggtaaacggaaacccgggtacggaaccgtaccggggtaataaggttttgttaattttaggttggttttttagtggtttttaagtttattaacgtaacggaaacgttcgtttccggacccggttaggggttcccgggggaacccgtaaacccgggg

SEQ ID NO: 438367 - DNA, 776 bp, Homo sapiens
  misc_feature: GZ8MTXP01B4QED.44.36.D03.1.454.CMB.2.raw
  modified_base (276)..(276): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgcttgggttttccttgttgcttattttagaaggtgtccactgtgaggtgcggctgggtggagtcgtgggggaggcgttgggtacgagggcgggggggtccctggagactctcctgtgcagcctcnggattcatcttcagtgactatgccatgaacgtcgggtcccgccgaggcctccgaagggggagggggtcgtggggaggttgggtttaccagttagttgttaatagttgcgtggagtaactacccgacccttaacgtacgtcaacggtaccttcgtagggtacggaaacggggtcccgtaactttacccgaacccgttaaacgtttccccggaaagggggaaccctaaaaggttacccgaaaccccgtaaaacgggggtaaacccctttacccgtaacgtttaacgggttaacttacccggttaaaggggtaaaaacttacggaaaaccgtaacgggacccgttaaagggaacgggtaaacggaaccggggaaacggggaacccgttaaccgggggtccttacggtttaccccgtttaacgttttccccggttaagggtttacccgggaaggtaacgggtaccggttcccgggggtaacccctttaacgggttttccggggg

SEQ ID NO: 438368 - DNA, 724 bp, Homo sapiens
  misc_feature: GZ8MTXP01BW511.44.36.D03.1.454.CMB.2.raw
  modified_base (328)..(328): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctacagtacatctctagaagagactagtttaaccatcctaccaaggaccacctacaaaggcaggtgtcttagatgaccaantcggaccctgcgacacaggacacatataactgtgacgtaacggggtaatcgggaacgggaaaagaaacgagtcgtttaggtttactagttaatttaacgttaaacgttacctttaacctagttccgtagggtaccgttcgggttagggggaaccgaaaacggggggtaccccgtaaccggggttacccaaccccggttccttccccgtaccgtacggtacccctttaccccgaaacccggtaaacccgggggtccccctaacggttccccgggttccccgtttcccccccggtcggggttccccgtcccccgttcggaccccgttcccgaacggggtaacccgcccgtaaccccgttccgggtcggggggaccctaaccgggccgggtccccgggg

SEQ ID NO: 438369 - DNA, 611 bp, Homo sapiens
  misc_feature: GZ8MTXP01AIAZF.44.36.D03.1.454.CMB.2.raw
  modified_base (406)..(406): a, c, t, g, unknown or other
  modified_base (459)..(459): a, c, t, g, unknown or other
  modified_base (507)..(507): a, c, t, g, unknown or other
  modified_base (544)..(544): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccagccgtgggacgggtccctgagtactctcctgtgtcgcctctggatccacatcagtcgaccactatagtggacgtcgggtcccgccgaggcctaccggagggggaaggggcgtagggagtggcgttgggaccgacgaaaggtaaaaacaaggttcgacctaagtctttaancaacgagacgtaccgcgcgtctgtagaaacgccaagtacttcccgaccccttnacgaaagcgagtacgtaccttacgaaaggtactcgtaattgatttcgngacgtaaatcgtaaaccttaaaccgacgaaaaccggnggaacgacgggcttagtgttaattagttgttgttgttagttaatatcgaggtaacttcgtaacccgg

SEQ ID NO: 438370 - DNA, 594 bp, Homo sapiens
  misc_feature: GZ8MTXP01D2N7A.44.36.D03.1.454.CMB.2.raw
  modified_base (286)..(286): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagttcagggcagagcacatgaccgaggacacgcacgagcacagcctanataggaactgagcgagtacgagagatcctaggagacagtagaattgtgtactacgtgtcgacgaggaccgggtaggaagaacgaaagaacgaaaagtaaaaggtaagtttacgtttagacgtacggtacgggaccgaacgggtaaccgtcggtaccgtaccggtctacccgtccgacgtcccctaccgaaccgaaccggccctacgtcccggttccccttccccgtccggccccttacccctcccgttaccgaacgtacgccttaccgttcgcggggaccaacggtccgccggccgtggccgtccggg

SEQ ID NO: 438371 - DNA, 722 bp, Homo sapiens
  misc_feature: GZ8MTXP01B01AU.44.36.D03.1.454.CMB.2.raw
  modified_base (283)..(283): a, c, t, g, unknown or other
  modified_base (447)..(447): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcgaggttgggtgggaggtccgggggagtacgttggtccaggccgtgggacgggtccctgagtactctcctgtcgtcgcctntggtatccaccatcagtcgaaccactatgtggacgtcggggtcccgccgacggtccgtaccgggaagggggacgggggtcgtggggtaggtcgggcgtttcgggacccgtaacgaaaacggttaaaaaaacgtaacggttcgaccctaaaggttaccttttaanacctaacgaaggtacggtaccgcccggtcgtcgtagtaacgaaacgccgaagtaccttcccaaccccttactaccgaaagacgtaatacgtaacttacgaaacggtacttacgttaattcgtatttccgtgaacgtaaagtaccgtaaaccttaaaccgtaacggaaaaccggaaggtaaacccgagggtaccttaagttacgtttaaagttttagtttggtttagtttgtttagttttaagtactacggttaggtaaccgttcggttaacccgg

SEQ ID NO: 438372 - DNA, 711 bp, Homo sapiens
  misc_feature: GZ8MTXP01EHJJZ.44.36.D03.1.454.CMB.2.raw
  modified_base (339)..(339): a, c, t, g, unknown or other
  modified_base (496)..(496): a, c, t, g, unknown or other
  modified_base (672)..(672): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagacgtttggtcccaggtcccgtgggacgggtcccctggacgtacctctcccgtggtcgtccgcctctggtactccaccatcagtcgaccatatagtggactcgggccgccgnggccgtaccggagggggaacgggggtcgtaggggagtcgggcgttcgggccgaacgtaaaggtaaaaaacaaggttcgaccctaaagtctttaagcaacgagtacgtaccggccgtcgtactggtaacgaaacgcccagtaccttcccaaccccttnacgaaaggagtatacgtaacttacgaaacggtacttcgtattgtaattccgtggaacgtaaattacgaaacccttaaaccggtaacggaaaaaccccgggaaggtaacccgttaacggggtacttaaagttagtttaaagtttgttttggttaggttttaagttacggtttttaanaacggttacgttaaacgggttaaccttcgggtaacccgg

SEQ ID NO: 438373 - DNA, 582 bp, Homo sapiens
  misc_feature: GZ8MTXP01CWF6W.44.36.D03.1.454.CMB.2.raw
  modified_base (190)..(190): a, c, t, g, unknown or other
  modified_base (224)..(224): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggccctgggcccagtctgccctgactcagcctgcctcgtgtctggtcncctggacagtcgtcaccatctcctgcacgtgganccagtcgtaatattcttagtcttacttgtctctgtatcaacatcataccgaaggtaaacgacccccaaactcatcatactatgagtacctaagaagacggtcctagtacgggtttctaacgtcgtcttcactcgaccctaccgaacgtccgacaaaccgccgccctcctagacatctcgtcgggctccgaggctacggaggacgagtctagtaatttattagttgttgctcagtgttcgttacgtcgctatcctattagtcgttacgttagggtaaggttcgggtaaacctaggttcccgttccgttaccgtaacggtaccaacgacccgaacggacccctaacccgttcgttaaccg

SEQ ID NO: 438374 - DNA, 634 bp, Homo sapiens
  misc_feature: GZ8MTXP01CP89J.44.36.D03.1.454.CMB.2.raw
  modified_base (337)..(337): a, c, t, g, unknown or other
  modified_base (421)..(421): a, c, t, g, unknown or other
  modified_base (473)..(473): a, c, t, g, unknown or other
  modified_base (480)..(480): a, c, t, g, unknown or other
  modified_base (491)..(491): a, c, t, g, unknown or other
  modified_base (500)..(500): a, c, t, g, unknown or other
  modified_base (606)..(606): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggtttttccttgtttgttattttacaaggtgtccagagtgaagtgcaggttgggtgggaggtccgggggagtacgttggtcccagccgttgggagggtccctggagtactctccgtgtcggtccgcctacgtggactcaccatcagtcgaaccatatagtcggacgtcgggtcccnccgacgggctaccggagggggaagggcgagggagtggcgttggaccgataaaggtaaaaacaaggttcacctaagtactttaancaagacgtacggacgcccgtctacgttagagaaacgccagtacttccacctnacgaagngatgtacttanaaggtactnattagtacttcaggactaaatcgtaacctaaaccgtagaaaaacccggtggaaccgagggtcaagttaggttatttagttgggttagttttggtaccgtttttaanacgttagttaacggtaacttcggtaacg

SEQ ID NO: 438375 - DNA, 679 bp, Homo sapiens
  misc_feature: GZ8MTXP01BJ22L.44.36.D03.1.454.CMB.2.raw
  modified_base (219)..(219): a, c, t, g, unknown or other
  modified_base (403)..(403): a, c, t, g, unknown or other
  modified_base (584)..(584): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacgttggtccagccgtggagggtccctgacgactctcctgtgtcgcctctggatcaccatcagtgaccactatagtggactcgggtcccgccaggcctccggagggggaagggggtctggggagtcgggcgttcgggaccgacaaaagttaaaaaaccgaagtttcgaccctagtccttttaancaaacgagaacgtaccgccgcgtctaggtacgaaacgtccaagtacttcccaaccctctacaaagtacgattacgaacttacgaaagtaccttatagtttaggtaatttcctaggaactaaagtcgtaaaccctaaaaccggtaaacggaaaaaaccccgggtagggaaccaaccgggggntaaagttggttaatttagtttggtagtttagttacgtttaattacgtaacgtaggtaacgttcgaccgttacgggtcggggccgtaaacccgggg

SEQ ID NO: 438376 - DNA, 593 bp, Homo sapiens
  misc_feature: GZ8MTXP01CCOWA.44.36.D03.1.454.CMB.2.raw
  modified_base (326)..(326): a, c, t, g, unknown or other
  modified_base (364)..(364): a, c, t, g, unknown or other
  modified_base (396)..(396): a, c, t, g, unknown or other
  modified_base (441)..(441): a, c, t, g, unknown or other
  modified_base (474)..(474): a, c, t, g, unknown or other
  modified_base (527)..(527): a, c, t, g, unknown or other
  modified_base (538)..(538): a, c, t, g, unknown or other
  modified_base (569)..(569): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcaggttggtggaggtccgggggagtacgttggtccaggccgtgggacgggtccctgacgactctcctgtcgtccgcccctggacttcaccatcagtcgaccactatagtggactggggtcccncaggctcgaggggagggctgggagtggcttggaccganaaacgtaaaaacagttcgaccagtactttaancagagacgtacgccgtgtctgtagaaacgcagtacttccaccctntacaaagagatacgaacttacaaacgaaccttntaatttgaactttcgagacgtaaattacgaaaccttaaaccacgaaaaccggngaacgacgggntaagttgttaaattgttgttgttattgttanaatcgaggaacttgccgtaacggg

SEQ ID NO: 438377 - DNA, 703 bp, Homo sapiens
  misc_feature: GZ8MTXP01CSGQP.44.36.D03.1.454.CMB.2.raw
  modified_base (445)..(445): a, c, t, g, unknown or other
  modified_base (614)..(614): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttatttacaaggtgtcagagtgaagtgcaggttggtggaggtccgggggatacgttggtccagccgtggacgggtccctgacgactctcctgtcgtcgcctcgtggactcaccatcagtcgacctatatagtcggactcggggtccccgccgacgggcctaccgggagggggaaacgggggtcgtagggggtacggtttcgggtttacgggaccgtaacgtaaaaacggttaaaaaaacgtaaaggttcgaccgtaagttaacttttaanccgtaaacgtaagaaacggttaccccgccggtcgttactaggtaacgaaaacgccctaagtactttacccaaccccttatacgaaagtagtataacgtaacttacgaaactactactaagtttcgattacgtgaacgtaatacggtaaactaaaccgtagaaaaaccgnggaacgacgggataagttagttaagttaagtttggttgttacgtttgttaaattcgttacgaaggttacttcggttaaccccgtaaggg

SEQ ID NO: 438378 - DNA, 572 bp, Homo sapiens
  misc_feature: GZ8MTXP01DRZSM.44.36.D03.1.454.CMB.2.raw
  modified_base (383)..(383): a, c, t, g, unknown or other
  modified_base (430)..(430): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacttggtccagccgtgggagggtccctgagactctcctgtgtcgcctctggatcaccatcagtgaccatatatggactgggtccgccaggctccgagggggagggctgggagtggcttggccgacaagtaaaaaacaagttcgacccaagtctttaancaacagacgtacgccgtgtctgtagaaagccagtacttcaacccctntacaagagatgaacttcaaaggtaactctaattgattcgtagacgtaaatgtaaacctaaacctagaaaaacccgnggaacacggggcttagtgttatttagttgttagttgttcgtttaatatcgaggtaacttgtaaccg

SEQ ID NO: 438379 - DNA, 583 bp, Homo sapiens
  misc_feature: GZ8MTXP01BVM7A.44.36.D03.1.454.CMB.2.raw
  modified_base (246)..(246): a, c, t, g, unknown or other
  modified_base (340)..(340): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttggganatataacctgtctctgtatacaaacaacatccaaggaccaaaacgcccccaaactctaattacttttgacgtccagtgagcgccgtcgaggttnttctaatccgtcttctctgctccgaaagtctcggccacgccgtcctcccgtgtcgatcctgtacgggcctccggctgacggacgaggtctgggacttagttacgcgcgtctactaatttaccaacttcgttagaacgtcggtttggggtcggttcggggcgggttagggtacctcaaccgttcggaacccggttccgtaacgggtccgacgccccgttaagggtcccttcccgggtccccccg

SEQ ID NO: 438380 - DNA, 693 bp, Homo sapiens
  misc_feature: GZ8MTXP01ATV6K.44.36.D03.1.454.CMB.2.raw
  modified_base (323)..(323): a, c, t, g, unknown or other
  modified_base (365)..(365): a, c, t, g, unknown or other
  modified_base (401)..(401): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttatttacaaggtgtccagagtgaagtgcaggttggtgggaggtccggggggagtacgttggtcccaggccctgggacgggtccctgagtactctcctgtgtcgcctctggatcaccatcagtcgaccactatagtggactggggtccnccgaggctccgagggggagggctgggagtggcttgggcccanaaagtaaaaaacgagttcgaccctaaagtctttaanccaagaggacgtaccggccgacgtacgtagtaacgaacgccgtaataccttacccaccctcaacgaagacgtactagtaaccttacgaaaggtaaacctttcgtaatttacgtaacttacgtacggtaaccgtaaaagttaccggtaaaaccctttaaaccccggtaaaacggaaaaaccccggggtaaggaaacccggaacgggtacttaaagtttaagttaacgtttagtttgggtttagttttaaggttattttaaccagttacggttacggtaaccgttcggaacccg

SEQ ID NO: 438381 - DNA, 739 bp, Homo sapiens
  misc_feature: GZ8MTXP01B8N6Z.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggtttttccttgttgtttattttacaaggtgtccagagtgaagtgcaggttggtggaggtccgggggagtacgttggtccgagccgtggacggtccctgacgactctctgtgtcgctctgatcacatcagtcgacctactatagtcggacgtcgggtcccgccgacgggccgtacccggaagggggaacgggggtcgtggggaggttcggtacgttcgggaccgaaccgtaaaaggtaaaaaaacgtaaggtttcgaccctaaaggttaccttttaagaccgtaaacgtaacgggtaacgtacccggcccggtcgttaccgtaggttaaacgaaaacgtcccgaaagttaccttaccccaacccgtttacaagaaaggacgtaacttacggaacctttaaccgaaaggtaaaccttcttaagtttcgtaactttcgagtacgtaaagtacgtaaacccttaaaaccgtacggaaaaaccccggaaggaacgaccgggattaaggttagttaatttagtttgttaggtttaatttaccggttttaatacgtacgttaggtaaccctttggtaaccccgg

SEQ ID NO: 438382 - DNA, 838 bp, Homo sapiens
  misc_feature: GZ8MTXP01DZC09.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaacgccctggagtggcttgcacacatcttctcgaatgaacgaaaatcctacagtacatctctagaagagcagtttaaccatctaccaaggacacctacaaaggcagggtcgttactttaagtactacgaaccctaaacgtacgttaccgggacccccttaggccgggaaacccaacccgacgggtaccaaccgtaaatttaaaccgttttaaacccgttgggtttaaccggaaccggtaaaaccggggggttaaaacttacgggggaaacccgggggtaaaaaacggaaaacccgtagggtcccgttttagggggttttaccttagggttaaactttaagttaaacggtttaaccctttaccctaagtttccgtagggtaaccgttacggttaggggggaacccaaaacggggggggggtacccctaaccggggttaccctaccccgggttctccccgttacgacggttaccctttacccgaacccggtaaaccgggggtcccctaagggttccccgggttccctttcccccccggtgggttaccccgtccccgttaacggttcccgttcccgggaacggggtaacccgtaccccgtccggtccggggccggggaccctaacccggcccggggtccccgg

SEQ ID NO: 438383 - DNA, 910 bp, Homo sapiens
  misc_feature: GZ8MTXP01CE7P8.44.36.D03.1.454.CMB.2.raw
  modified_base (292)..(292): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgtttattttacaaggtgtcagagtgaagtgcgaggttgggtgggaggtccgggggagtacgttggtccatccgtggaggtccctgagactctcctgtcgtcgctcgtggatccacctntcgagtcgaacctactaagtagtcggaccgtcggggtcccgccgacggccgtaccggaaggggggaagggggtctgggggacgttcggggtaccgttcgggaccccgtaaacgaaaacggttaaaaaaaacgtaaaggtttccgaacccgtaaaacggttctttttaacncccgaaaccggtaaaggtaaccggtaacccggcccggttacggttaccgttaggtaacggaaaacgtccctaaaggttaacctttccccaaaccccgtttaccgtaaacgaaagggtaacaaacgtttaccggtaaaccttttaaacgaaaaaccggggttaactttaaccgttaaaagttttcggtaaacgttttaccgaacgggtaaccggttaaaactttaaccggtaaaaccccgttaaaaacccccggtaaagggaaaaaaaacccccgggggtaagggaaaccccggttaacgggggttaaaccttaagggttttaaacggttttaaagtttttaagggtttcggtttttacgggtttttaaggttttaaaggttttaaatttaaacccgttacgggttaaaacgggtttaaaccccgtttcggggtttaaaaccccccggg

SEQ ID NO: 438384 - DNA, 646 bp, Homo sapiens
  misc_feature: GZ8MTXP01CZXVJ.44.36.D03.1.454.CMB.2.raw
  modified_base (282)..(282): a, c, t, g, unknown or other
  modified_base (321)..(321): a, c, t, g, unknown or other
  modified_base (410)..(410): a, c, t, g, unknown or other
  modified_base (561)..(561): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttatttacaaggtgtcagagtgaagtgcaggttgggtgggaggtccggggggagtacgttgggtccaggccgtgggacgggtccctggagctctccgtgtgtcgcctntggatcacatcagtgaaccatatatggactcgggtcccnccgaggcctccggagggggaagggggctggggagtgggtcttgggaccgacaaaggtaaaaaacaggttcgacccaaagtacttttaanaccgtaagaaggacgtaaccggcccgtacgtctagtagaaacgccaggtacttccaccctctacaagagatagaacttacaaaggtaaccttctaattcgtaattccgagtaccgaaatcggtaaacctaaaccgtaacggaaaaacccgngggaaccgttacgggattagttaggttaatttagttgttgtttaacgttgtttaatacgtacgaaggtaaccttggtaaccccgg

SEQ ID NO: 438385 - DNA, 657 bp, Homo sapiens
  misc_feature: GZ8MTXP01DAJSJ.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatagaacgaaaatcctacagtacatctctagaagagactaacgtttaaccatactaccaaaggacaccctaccgaaaaggcaggttggtactttaagtatagaccaacatcggacctgacgacaccgaggcaacatattaactgtcgacgaacgggtaaatgggaacgggaaaagaaacaaggtctttagggtttactagttaattaacgttaaagttacttaaccattcgtaggacgtcggtaggggaaccaaacggggggtaccctaacgggtaccaaccggtcctcccgtcgacgttacccttacccgaaccgtaaccggcccctaagttcccggttcccttcccccgtggcccgtccccgtcgcccgttcgaacggccgaccgtaaccgttcggcgggggaccaacggcggccccgggg

SEQ ID NO: 438386 - DNA, 659 bp, Homo sapiens
  misc_feature: GZ8MTXP01BVION.44.36.D03.1.454.CMB.2.raw
  modified_base (282)..(282): a, c, t, g, unknown or other
  modified_base (324)..(324): a, c, t, g, unknown or other
  modified_base (422)..(422): a, c, t, g, unknown or other
  modified_base (472)..(472): a, c, t, g, unknown or other
  modified_base (480)..(480): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcaggttggtggaggtccgggggagtacgttggtccaggcccgtgggacgggtccctgacgtactctcctgtgtcgcctntggatcaccatcagtcgaccactatatggactcggggtcccnccgaggcctccggagggggaacgggggctggggaggtcgggtacgttggggaccgaccgtaaaggtaaaaaactaaggttcgaccctaagtctttaancacgagtacgtaccgccgcgtctgtagaaacgccagtacttccacccctntacaaagngatcgaacttacaaacggtaacttctaagtttgaactttccgtagaccgtaaatcgtaaacccgtaaaccgtaagggaaaaccccgaagggtaacgaccggggtacttaagttcggttaatttagtttgggttgttttgttagtttaatacgtagttaacgggtaacttggtaaccccg

SEQ ID NO: 438387 - DNA, 683 bp, Homo sapiens
  misc_feature: GZ8MTXP01EMZDA.44.36.D03.1.454.CMB.2.raw
  modified_base (279)..(279): a, c, t, g, unknown or other
  modified_base (566)..(566): a, c, t, g, unknown or other
tcagacagtatatacacgaccggtgctcgatttagctgcgtcacgatctctcttgggagctctcagagaggtgccttagccctggattccaaggcattttccacttggtgatcagcactgaacacagaggactcaccatggagttgggctgcgcttgggttttccttgttgcttattttagaaggtgtccatgtgaggtgcggctggtggagtcgtgggggagtcgttgggtacgagggcgggggggtccctggacgactcctccgtgtgcagcctcgnggattcatcttcagtgactatgaccatagaacgtcggggtcccgccgaggccctccggaagggggaagggggtcgtgggtaggttggggtttaccaagttattagttaaattagttagcgtgggaactaacttaaccccgaccttaccgtacgctaagtaccttcgtaggtacgggaacgggccctatttaccccgaaaccttaacgttcccgaagggaaccaagtacgaacccctaaaggtactacctaacgttagtaactccgttaaagaaacgttacgaaaccncgtacgtaggaaggaacggaaacggacgggacaaccgggtccttgttacccgtttctttacgtcggtttacggaaggttaacggcggttacccggggtccctttaagggtttccggg

SEQ ID NO: 438388 - DNA, 681 bp, Homo sapiens
  misc_feature: GZ8MTXP01D9I6X.44.36.D03.1.454.CMB.2.raw
  modified_base (340)..(340): a, c, t, g, unknown or other
  modified_base (379)..(379): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacattcttctacgaatagaacgaaaaatcctaacagtacatctctagaagagcaagtttaaccatctaccaagtaccacctacaaaggctaggtgttactttagatacgaacccaanagtcggaccctgacggacaccaggcaactatacttaacngtgacgtaacgggtaaagtcggaacggggtaaaagaaacgagtacgttaggtttacttagttaattaattaagttacttaccagtcgtggacgtcggtagggaccgaaacggggggtacccgtacgggtacccacccgttcctccctcgacgtacccttacccgaaccgaccgggtccccacgttcccggttccccgttcccccgtcgggccccgtccccgttcggcccgttcccgacggggtaaccccgtacccgtaacccggtcggggtccgggggacccaacccgggcgggtccccggg

SEQ ID NO: 438389 - DNA, 595 bp, Homo sapiens
  misc_feature: GZ8MTXP01E1MT8.44.36.D03.1.454.CMB.2.raw
  modified_base (376)..(376): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgctctggatcaccatcagtgaccactatatggactgggtcccgccaggctccgaggggaagggggctgggagtggcttgggccgcagtaaaacaagttgcccaagctttaancacagacgtacgccgcgtctgtagaacgccagtacttcccacccctctacaaagagatacgtaacttacaaacggtaactctattagtacttcgtgacgtaaatcgtaaacctaaaccgtaacggaaaacccggaaggaaccgacggggtacttagttagttaattagtttggttgtttgttagtttaatagtacgaacggtaaccgttcggtaacccg

SEQ ID NO: 438390 - DNA, 805 bp, Homo sapiens
  misc_feature: GZ8MTXP01C0TTW.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacgccctggagtggcttgcacacatcttctcgaatgaacgaaaatcctacagtacatctctagaagagactaagtttaaccatcctaccaaaggaccaacctaccgaaaaggcctaggtgttactttaagtatcgaacccaaacagtacggacccctgaccggacaccaggacaactattacttaaaccttgtgacgtaaacggggtaaagtacgggaacggggaaaaacgaaaccagggtaccgtttaggtttacttaggttaatttaaacgttaaacggttacctttaacctagttccggttaacggggtacgttccgggtaggggggaaacccgtaaaacgggggggtaccccgtaaccgggggttacccctaacccgggttacccgtttccccaacccggttacggtaccccctttacccgtaaaccccggaaacccggggtccccctaacggtttccccgggtcccctttcccccccgggtgggcccccgttaacccccgtcggttaacccccgtttcccggaacgggtaacccggccccgtaacccggtttcccggggtaccggggggacccctaacccgggcccgggtcccccggggg

SEQ ID NO: 438391 - DNA, 779 bp, Homo sapiens
  misc_feature: GZ8MTXP01BKXA5.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagacgaccctcacgctgacctgcaccatctctgggttctctctcaacgatattagaatgggtgtgagctggatccgtcacgcccccgagggaacggcctggagtggcttgcacacatcttctacgaatagaaacgaaaactcctaacagtactatctctagaagacgactaacgtttaaccatacctaccaacggaccacctaaccgaaaggcgaggttgttactttaagtatacgaaccaacacgtacggaccctggaccgacaccgaggacaactaatacttaacgtgtcggaacgtaacggggtaaacgtacgggaaacgggaaaacgaaacgtacgtacgtttagggtttacttagttaatttaaagtaacgtttacccttaacgtagttcccggtagggtaccgttcgggtaacgggggtaaccgaaacggggggggtaacccgtaccggggttaccctaacccgggttcctaccccgttacgaccgttaccccgttaccccgaaacccgggtaaccggtcccccgttaacggttccccggttccccgtttccccccgggacgggttcccccgtcccccgttggttcccccgttccgggaaccgggaacgtccccgtaaccggtcggggttacgggggacccaaccgggttcccgggccccgggg

SEQ ID NO: 438392 - DNA, 542 bp, Homo sapiens
  misc_feature: GZ8MTXP01D6U4L.44.36.D03.1.454.CMB.2.raw
  modified_base (277)..(277): a, c, t, g, unknown or other
  modified_base (364)..(364): a, c, t, g, unknown or other
  modified_base (518)..(518): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaagtgtccactgtgaggtgcggctgggtggagtcgtgggggaggcttgggtacgagggcggggggggtccctggagactctccgtgtgcagcctcnggattcatcttcagtgactatgccatgaactgggtccgcaggctcgagggagggctggagttggtttccatatgtaatatgctgganactaccactactacgcagctcgtgtagaagggcctattccaacctaattccgaagggaccaagtcgaccaaaggactcactagtatacgtaggaaatacgaacagactgaacgaagacggaggacacgggcttgttcgttcttcttgtcgaagngacgttcggtcccttaagttcggg

SEQ ID NO: 438393 - DNA, 617 bp, Homo sapiens
  misc_feature: GZ8MTXP01DE1WX.44.36.D03.1.454.CMB.2.raw
  modified_base (222)..(222): a, c, t, g, unknown or other
  modified_base (266)..(266): a, c, t, g, unknown or other
  modified_base (378)..(378): a, c, t, g, unknown or other
  modified_base (397)..(397): a, c, t, g, unknown or other
  modified_base (480)..(480): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcagttggtggagtccggggganacttggtccagcctggaggtccctgagactctcctgtgtcgctntgatcacatcagtgaccatatatggactggtccgcaggctccgagggggaacgggcgtgggagtggcgttggccgaccgaaagtaaaaacaaagttgacctaagtctttaancaacaggacgtaccgccgngtctgtagaaacgccaagactttcccaacccttctacaaagagatagaaccttacgaaacggtaacttacaattagatttccnggactaaaagttgaaaacccttaaaccgtaacggaaaaaccccggaaggaaaccgacggggtacttaaaggtttagtattttagttcgttaggttttgtacgttttaatactcgttaacggtaacgttcgtaacccg

SEQ ID NO: 438394 - DNA, 652 bp, Homo sapiens
  misc_feature: GZ8MTXP01EHCCB.44.36.D03.1.454.CMB.2.raw
  modified_base (277)..(277): a, c, t, g, unknown or other
  modified_base (408)..(408): a, c, t, g, unknown or other
  modified_base (463)..(463): a, c, t, g, unknown or other
  modified_base (511)..(511): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgtttggtccaggcccgtgggacgggtccctgagctctcctgtgtcgcctntggatcaccatcagtcgaccactatagtggacgtcgggtcccgccgaggcgtcccgagggggaacggggcgtgggaggtcggcgttcggaccgacaaaggtaaaaaacaaggttcgacctaagtctttaancaacgagacgtaccgccggtcgtctgtagaaacgccaagtacttccaaccccttntacaaagagactagtacttacaaaggtaactcgtaattgtactttcgngtaacgtaactacgtaaaccgtaaaccgtaaacgggaaaacccggaacggaaccgaacgggaacttagttagtttaagttttgtttggtttaggtttgtttagtttaacttagtacggttaacgttaaccgttcgtaaccg

SEQ ID NO: 438395 - DNA, 770 bp, Homo sapiens
  misc_feature: GZ8MTXP01BGALZ.44.36.D03.1.454.CMB.2.raw
  modified_base (448)..(448): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgtttgtttattttacgaaggtgtccagagtgaagtgcgtaggttgggtgggagggtccgggggagtacgttggtccaggtccgtgggtacgggtccctggacgtacctcttccgttgtcgtccgccttcgtggtactccacctatccagtcgaaccctactatagtggacgtcgggtcccgccgaggcctaccggagggggaaggggcgtgggaggtggcgttcgggaccgaacgtaaaggtaaaaaactaggttcgaccctaaagttactttaanaccaacgaggtacgtaccggcccggtacgttacgtaggtaacgaaacgtccctaagttacctttaccccaacccccgtttactaacgaaaggtagtaacttacgtaacctttaacgaaaacggtaactttactaagtttggtaacctttacgtcggtaacgtaaacttaccggtaaaacccgttaaaccgtaaaccggaaaaccggggaacgaaaccgggttacgggaacttagttaaaggtttaattttaggttttggttagtttttgggtttattttaacgttagtacggttaaacggttaaccgttccgggtaacccgg

SEQ ID NO: 438396 - DNA, 732 bp, Homo sapiens
  misc_feature: GZ8MTXP01DABDW.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctacgaatagaaacgaaaatcctaacagtacatctctagaagagactaagtttaaccatcctaccgaaggaccaccctaaccgaaaaggcgaggttggttactttaagtatacgaacccaacacgtacggaccccgtggacggacaccgacggacacgtatattaacgtgtgacgtaacgggtaatgggaacgggaaagaaacagtacgtttggtttactagttaattaagttaaacgttacttacctagttcgtagggtaccgtcggtacgggggaaccgaaacggggggtaccccgtaccggggttaccctaccccggttccttacccgtaccgtacggtacccctttacccgaacccggtaaccgggtcccctaacggttccccgggttcccctttccccccggtcggggcccctccccggtcgaccccgttccggaacgggtcccgaccctaacccggtccgggtacgggggaccctaaccggaaccgggtccccggg

SEQ ID NO: 438397 - DNA, 588 bp, Homo sapiens
  misc_feature: GZ8MTXP01ECLE6.44.36.D03.1.454.CMB.2.raw
  modified_base (227)..(227): a, c, t, g, unknown or other
  modified_base (287)..(287): a, c, t, g, unknown or other
  modified_base (307)..(307): a, c, t, g, unknown or other
  modified_base (376)..(376): a, c, t, g, unknown or other
  modified_base (431)..(431): a, c, t, g, unknown or other
  modified_base (440)..(440): a, c, t, g, unknown or other
  modified_base (462)..(462): a, c, t, g, unknown or other
  modified_base (477)..(477): a, c, t, g, unknown or other
  modified_base (512)..(512): a, c, t, g, unknown or other
  modified_base (523)..(523): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggttgtccagagtgaagtgcagttggtggaggtccggggganacttggtccagcctggagggtccctgagactctcctgtgtcgctctggatcacatcagtnaccatatatggactggtccncaggctccgagggagggctggagtggcttggccgacaaggtaaaaaacaagttgacccaagtctttaancaacaggataccggcgtcgtctgtagaaaacgcccaagtactttcccaacccttntacaagganatgaacttacaaagggtacctntaattggaatttccngaccgaaatcgaacctaaacctaggaaaacccggngacacggggtnagttgtaatttagttgttagtttgttacgtttaatagtccgttaagggtaaccttggtaaccccg

SEQ ID NO: 438398 - DNA, 672 bp, Homo sapiens
  misc_feature: GZ8MTXP01C26VP.44.36.D03.1.454.CMB.2.raw
  modified_base (280)..(280): a, c, t, g, unknown or other
  modified_base (582)..(582): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttatttacgaaggtgtcagagtgaagtgcaggttgggtgggaggtccgggggagtacgttggtccaggccgtgggacgggtccctgagctctcctgtgtcgcctntggatcaccatcagtcgaccactatagtggactcgggtcccgccgaggctaccggaggggggaaggggtcaggggtagtgggtccgttggggacccgaccgtaaaaggtaaaaaaactaaggttcgacccctaaaagttccttttaagacaacgaagggtacgtaccggccggacgttcgtagtacgaaaactcgaagtacttcccaacccttctacgaaagagtatagtacttacgaaaggtactctaattgactttcgagactaaagtcgtaaaccttaaaccaacggtaaaaacccggnggaaccgaaccggggtacttagttagttaatttagtttgttcgtttaaggttatttaagtacgtacgttaggtaaccttggtaaccccgg

SEQ ID NO: 438399 - DNA, 713 bp, Homo sapiens
  misc_feature: GZ8MTXP01BTHLJ.44.36.D03.1.454.CMB.2.raw
  modified_base (406)..(406): a, c, t, g, unknown or other
  modified_base (463)..(463): a, c, t, g, unknown or other
  modified_base (472)..(472): a, c, t, g, unknown or other
  modified_base (528)..(528): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagtacgttggtccagccgtgggagggtccctgagactctcctgtgtcgcctcgtggatcaccatcagtgacctactatagtggacgtcgggtcccgccgaggcctccggagggggaaggggctgggagtggtcgttggaccgacaaaggtaaaaacaaggttcgacctaagtcctttaancgaacagacgtaccgccgtcgtctagtacgaaacgccaagtacttcccaaccccttntacaaaganagttcgaaacctttacgaaaggggtaaccttcgtaagtttacgtaacgtttcccgnggtaaacccgtaaaagttccgtaaaacccgtttaaaacccgtaaacggggaaaaaacccccgggaaggggaaacccggttacgggggaccttaaaggtttaacggtttaagttttaagtttggtttacggtttaagttttaggtttaactagtacccggttaaggtaaccttcggggtaaccccg

SEQ ID NO: 438400 - DNA, 737 bp, Homo sapiens
  misc_feature: GZ8MTXP01AC4WV.44.36.D03.1.454.CMB.2.raw
  modified_base (218)..(218): a, c, t, g, unknown or other
  modified_base (290)..(290): a, c, t, g, unknown or other
  modified_base (307)..(307): a, c, t, g, unknown or other
  modified_base (349)..(349): a, c, t, g, unknown or other
  modified_base (381)..(381): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggagtccggggganacgttggtccagccgtggagggtccctgagactctcctgtgtcgcctctggattcacatcagtcgaccactntagtggactgggtcccncgaggctccgagggggagggctgggagtggcgttggccgtanaaagtaaaaacaagttcgacctagtctttaanacgaacgagcgtaccgccgtgtacgtaggtacgaaacgaccctaagtaccttacccacccgtactaacgaaagagtaacgttacgtaaccttaacgaaaacgtaaccttacttaagtttacggtaacgtttacgtacggtaaacgtaaacgtaaccgtaaaacccgttaaaaccggtaaacgggaaaaacccgggtacgggaaaccgtaacggggtaacttaagttaggtttaaattttaggtttgggtttaggttttaggtttagttttaaccgttacgttaaccggtaaacggttaacccgttcgggtaccccggttaaccggggtaacccgggggaacccggtaaccccgggg

SEQ ID NO: 438401 - DNA, 750 bp, Homo sapiens
  misc_feature: GZ8MTXP01EPQQN.44.36.D03.1.454.CMB.2.raw
  modified_base (285)..(285): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgttattttacaaggtgtccagagtgaagtgcaggttggtgggaggtccgggggagtacgttggtccagccgtgggacggtccctgacgtactctcctgtcgtcgcctctgntcacatcagtcgaccactatagtggacgtcgggtcccgccgaggccgtaccggaagggggaacggggcgtggggagtcgggtcgttcgggacccgaacgtaaaacggtaaaaaaacgtaaggttcgacccgtaaacgttacttttaacgaccgaaacgtaacggtaaccggtacccggccggtacggttaccgttagggtaaacgaaaaccgcccgtaaaggtaacctttacccgaaaccccttcgtaacgaaacggagtaactacgtaacctttacgaaacgttaaactcttaagttagtaactttccgagtaccgtaaattacggtaaacccttaaaccgaaacggaaaacccgggaacgtaaaccggacgggtacttaaggtttacgttaaagttttagtttggtttagtttcggtttagttttaataccgttaggaacggttaacgttcgggtaaccccgg

SEQ ID NO: 438402 - DNA, 746 bp, Homo sapiens
  misc_feature: GZ8MTXP01AW77C.44.36.D03.1.454.CMB.2.raw
  modified_base (273)..(273): a, c, t, g, unknown or other
  modified_base (282)..(282): a, c, t, g, unknown or other
  modified_base (313)..(313): a, c, t, g, unknown or other
  modified_base (413)..(413): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagccgtgggaggtccctgagactctcctgtgtcgctntggatcacntcagtcgaccactatagtggacgtgggtccnccgaggcctaccggagggggaacggggctaggggagtcggcgttcgggaccgaacgtaaaaggtaaaaaacaaggttcgacccgtaaagttccttttaanaccgaaacgaaggtaaccggtacccggccgtacgttacgtagtaacggaaaaccgcccgaaagttacctttacccaaccccttgtaaccgaaagtacgtattacgtaacctttaacgaaaacggtaccttaagtaagtttacgtatttcccgagtaaccggtaaattccgtaaacccgttaaaaccggtaaacggaaaaccccgggtaaggtaacccggaaccggggtcttaaagtttaggttttaaagttttacggtttggttttacgggtttaagtttaagttttaataacgttaccggttaaagggttaaccgttcgggttaaccccggg

SEQ ID NO: 438403 - DNA, 616 bp, Homo sapiens
  misc_feature: GZ8MTXP01A645E.44.36.D03.1.454.CMB.2.raw
  modified_base (274)..(274): a, c, t, g, unknown or other
  modified_base (277)..(277): a, c, t, g, unknown or other
  modified_base (411)..(411): a, c, t, g, unknown or other
  modified_base (434)..(434): a, c, t, g, unknown or other
  modified_base (559)..(559): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgtttatttacaaggtgtccagagtgaagtgctaggttgggtggaggtccgggggagtacgttggtccagccgtggacggtcctgagtctctcctgtgtcnctntgtctcacatcagtcgaccactatagtggacgtcggtcccgcgaggccgtacggagggggaacgggcgtgggaggtcggtcgttcggaccgacgtaaacggtaaaaacgtaagttcgacctaaagtactttaancgaacaggacgtacgccgtgtcngtagaaacgcagtacttcccacctacacaagagtatacgtacttacgaatactattatgtacttcgagtacgaatcgtaaactaaccgtaacggaaaccgaaggacgacgggttacagttatttnttagttttgttaggtttgttagtttaacagtacgttaagtaaccgttcggtaacccg

SEQ ID NO: 438404 - DNA, 647 bp, Homo sapiens
  misc_feature: GZ8MTXP01DRSVE.44.36.D03.1.454.CMB.2.raw
  modified_base (378)..(378): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcagttggtggagtccgggggagacttggtccagcctggagggtccctgagactctcctgtgtcgcctctggatcaccatcagtcgaccactatatggactgggtccgccaggctccgaggggagggctgggagtggcgttggccgacgaagtaaaaacaagttgcccaagctttaancacagacgtacgccgcgtactgtagaaagccagtacttccgaccctctacaagagtaatgaacttaccgaaagggtaaccttcgaaatttcgaatttcccgtaggaccggtaaaattcggtaaacccttaaaacccgtaggaaaaaaaccccggaaggggaaacccaacgggggccttaaagttgtttaatttaagttttcgggtttagtttggtttaacggtttttaataacgtaccggttaagggtaacccgttggttaacccccgg

SEQ ID NO: 438405 - DNA, 637 bp, Homo sapiens
  misc_feature: GZ8MTXP01BUVWL.44.36.D03.1.454.CMB.2.raw
  modified_base (269)..(269): a, c, t, g, unknown or other
  modified_base (449)..(449): a, c, t, g, unknown or other
  modified_base (504)..(504): a, c, t, g, unknown or other
  modified_base (553)..(553): a, c, t, g, unknown or other
  modified_base (587)..(587): a, c, t, g, unknown or other
tcagacagtatatacacgaccggtgctcgatttagctgcgtcacgatctctcttggggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacttggtcccccccagccgtggacgggtccctgagctctcctgtgtcncctctggacttcacatcagtgaccactatagtcggacgtcgggtccgccgaggcctccggagggggaacggggcgtgggaggtggcgttgggccgacaaagtaaaaacaagttccgacctagtctttatcaacgagtcgtacgcccgtcgtctgtagaaacgcccagtcttcccaccctntaccaagagtactagtaccttacgaaagtaaccttctaagttgggtactttacgngacgtaaatcgaaaccttaaacgtacgaaaacccggtgaaacgtcgggntaagtgttatttagttgttagttgttacgtttantaacgtaagggaacttcgggtaccaccgggtcggggaacccgtaaccggg

SEQ ID NO: 438406 - DNA, 630 bp, Homo sapiens
  misc_feature: GZ8MTXP01AHWVJ.44.36.D03.1.454.CMB.2.raw
  modified_base (285)..(285): a, c, t, g, unknown or other
  modified_base (313)..(313): a, c, t, g, unknown or other
  modified_base (386)..(386): a, c, t, g, unknown or other
  modified_base (495)..(495): a, c, t, g, unknown or other
  modified_base (536)..(536): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtggaggtccgggggagacgttggtccagccgtgggacggtccctgagctctcctgtgtcgcctctggatcaccntcagtgaccatatatggactgggtcccncaggctccgaggggagggctgggagtggcttggcccgagaaagtaaaaacaagttcgaccctaagtctttaancaacgagacgtaccgccgtcgtactgtagaaacgccaggtacttcccaccccttacaaagagtactagaaccctttagaaacgggtaacttcagtttcgaactttccgnggactaaagtcgaaacccttaaaccgaggaaaaaacccggnggaaccgacggtattaagttacgtttaagtttgtttgttaggttttaagttagtttaacgtacgtacggttaacggtaaccttcgggtaacccg

SEQ ID NO: 438407 - DNA, 675 bp, Homo sapiens
  misc_feature: GZ8MTXP01BYKL5.44.36.D03.1.454.CMB.2.raw
  modified_base (278)..(278): a, c, t, g, unknown or other
  modified_base (425)..(425): a, c, t, g, unknown or other
  modified_base (483)..(483): a, c, t, g, unknown or other
  modified_base (590)..(590): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccaggccgtgggacgggtccctgacgactctcctgtgtcgcctntggatcacatcagtcgaccactatagtggaccgtcgggtcccgccgagggcctaccggagggggaacgggggtctgggggaggtcggtcgttcggggaccgaaccgaaaggtaaaaaacgtaaggttcgaccctaaagtcctttaancaacgagacgtaccgccgtctctagtagaaacgtcaagtactttacccaacccccttntaacgaaaggtagaacttacgtaactttaaccgaaaggtaacccttagtatttagactttcgagacgtaaatcgtaaaaccctaaaccgtaacgggaaaaacccggngggaacccgacggggtacttaagttaggttaatttagttgttaggtttgttagtttaatatccgaagtaaccgttcgtaacccgg

SEQ ID NO: 438408 - DNA, 480 bp, Homo sapiens
  misc_feature: GZ8MTXP01BEQBW.44.36.D03.1.454.CMB.2.raw
  modified_base (373)..(373): a, c, t, g, unknown or other
  modified_base (468)..(469): a, c, t, g, unknown or other
  modified_base (471)..(480): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagctggtcttcaatctagtgggccgtggcaccctggcactgtctcctcagcttccaccagggccccatccggtccttccccctggccgcccctgcctccgaggacgccaccgtcgtcgggggcacgngccggccctggggcctggccctgggtaccaacgggtacttacgttcctatacttactgtctggaggcggggcgtgggacgaagggcgacgatagnngnnnnnnnnnn

SEQ ID NO: 438409 - DNA, 731 bp, Homo sapiens
  misc_feature: GZ8MTXP01CIU3F.44.36.D03.1.454.CMB.2.raw
  modified_base (440)..(440): a, c, t, g, unknown or other
  modified_base (631)..(631): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgctaggttggtgggaggtccgggggagtacgttggtccgacggccccggagggtccctgagtactctcctgtcgtcgcctctggacttcaccatcagtcgaccactatagtggacgtcgggtcccgccgacgggcctaccggaagggggaacgggggcgtaggggaggtcgggtcgttcgggaccgtacgaaaacggttaaaaaacctaaaggtttcgacccgtagttaccttttaanccgaaacgaacggacgttaccggcccgtacgttcgtggtaacgaaaacgcccgtaagttacctttacccaccccgttataccgaaaaggtacgtacttacgtaacctttaacgaaacgttaacttctaagttttcgaacttttccaggtactaaacgttacgaaaccttaaacccggaaggaaaacccggnggaaccgacgggttatagttagttaaagttttagttggttgtttacggtttaatttacgtaatccgggtaaggttaccttcggttaaccccgtaaggggg

SEQ ID NO: 438410 - DNA, 600 bp, Homo sapiens
  misc_feature: GZ8MTXP01AZYM2.44.36.D03.1.454.CMB.2.raw
  modified_base (434)..(434): a, c, t, g, unknown or other
  modified_base (458)..(458): a, c, t, g, unknown or other
  modified_base (483)..(483): a, c, t, g, unknown or other
  modified_base (520)..(520): a, c, t, g, unknown or other
  modified_base (545)..(545): a, c, t, g, unknown or other
  modified_base (554)..(554): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggtttttccttgtttgttatttttacaaggtgtccagagtgaagtgcaggttggtgggaggtccgggggagtacgtttggtccaggtcccgtggggacgggtcccctggacgtacctctcccttggtcgtccgcccttcgtggacttccaacccattcgagtcgacccactatagtgggactcgggtcccgcagggctccggagggggaaggggctgggagtggcttgggccgacgaaaggtaaaaaacaaggtttcaccctaaagtctttaanccaacgagacgtaccgccgcgtcngtagaaacgccagacttccaccctntacaagagatcgacttacgaagaactctattgattcngacaatcgaactaacgagaaaacgngacacgggnagtgtattgttgttgttgttgtttaacatcgaaggtcttcgtcccg

SEQ ID NO: 438411 - DNA, 642 bp, Homo sapiens
  misc_feature: GZ8MTXP01AKS06.44.36.D03.1.454.CMB.2.raw
  modified_base (398)..(398): a, c, t, g, unknown or other
  modified_base (415)..(415): a, c, t, g, unknown or other
  modified_base (420)..(420): a, c, t, g, unknown or other
  modified_base (502)..(502): a, c, t, g, unknown or other
  modified_base (546)..(546): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttttccttgttgttattttacaaggtgtccagagtgaagtgcaggttggtgggagtccgggggagacttggtccagccgtgggagggtccctgagactctcctgtgtcgcctctggatcaccatccagtcgaccactatagtggactcggggtcccgccgaggcctccgagggggaggggctgggagttggcttgggccgacgaaagtaaaaacaaggttcgccaaagtctttaancacagtacgtacgccgngttcngtacgaaagtccaagattcccaaccccttctacgaaagcgtaatcgaactttcaaagggtaacttctaattcgaactttcgngtaccgaaattcggaacccttaaaaccgtcggaaaaacccgggnggaaccgacggggtacaagttagggtaatttttaggttgttacggttttgttaaggttttctaacgttcgaacggggtaaccttggttaaccccgg

SEQ ID NO: 438412 - DNA, 620 bp, Homo sapiens
  misc_feature: GZ8MTXP01BNRK3.44.36.D03.1.454.CMB.2.raw
  modified_base (314)..(314): a, c, t, g, unknown or other
  modified_base (392)..(392): a, c, t, g, unknown or other
  modified_base (439)..(439): a, c, t, g, unknown or other
  modified_base (472)..(472): a, c, t, g, unknown or other
  modified_base (487)..(487): a, c, t, g, unknown or other
  modified_base (528)..(528): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacttggtccagccgtgggacgggtccctgagactctcctgtgtcgctctggatcaccatcagtgaccactatagtggacgtgggtcccnccgaggctaccgagggggaagggctgggagtggcttggccgacaaagtaaaaaacaagttcgacctaagtcttttaancaacgagacgtaccgccgcgtctgtagaacgccagtacttcaccctntacgaagagatgaacttacgaaaggtaaccttntattagtatttccgngtacgtaaatcgtaaaccctaaaccgtaacggaaaacccgnggaaccaccggggtattagttagttagtttaagtttggttagttttggttagttttaactagtaccgttaagggtaaccttcggtaacccgg

SEQ ID NO: 438413 - DNA, 813 bp, Homo sapiens
  misc_feature: GZ8MTXP01CVXZA.44.36.D03.1.454.CMB.2.raw
  modified_base (226)..(226): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttggtgggaggtccggggganacgttgggtccaggccgtgggacgggtcccctgacgtactctcctgtcgtcgcctctggatcaccatcagtcgacctactatagtggaccgtcgggtcccgaccgtagggtcctcccggaaggggggaacgggggtccgtagggggtacggtgggtaccgtttcggggacccgaaccgaaaacggttaaaaaaaccgaaggtttccgaccccgtaaaggttacccttttaacgtacctaaacggtaacgggaacggttaccccgggcccggtaccggttacgtacgggttaacggaaaacggtacccctaagggttaaccctttaccccgaaaccccccggtttacttaaacccggaaaaggtaccgggttaacttaacgggtaaacccttttaaaccgaaaacgggggttaaacccttaccgtaagttttacggtaactttaccgtcgggtaaacccgtaaagtaccgtaaacccgtaaaccgttaaacgggaaaaccccgtgggtaaaccgacggggtacagtttaagtatttaagttgttagtttgttagtttaatacgtacgttaggtaacgttgtaacccgg

SEQ ID NO: 438414 - DNA, 688 bp, Homo sapiens
  misc_feature: GZ8MTXP01B0RAQ.44.36.D03.1.454.CMB.2.raw
  modified_base (276)..(276): a, c, t, g, unknown or other
  modified_base (385)..(385): a, c, t, g, unknown or other
  modified_base (438)..(438): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccagccgtgggacgggtccctgagactctcctgtgtcgctntggatcacatcagtgaccatatatggactcgggtccgccaggctccggaggggagggctgggagtggcttggccgacaaggtaaaaacaagttcgcccaagtctttaancaacagacgtaccgccgtcgtctgtacgaaacgccagtacttcccaacccctntacaaggacatcgaacttacaaaggtaacttcgtaatttcggtaaactttcgtacggtacggtaaaacttcgtaaaacccgttaaacccgtaaacgggtaaaaaaccccgggaagggaaacccggttaacgggggtaccttaaaggtttaacggtttaagttttaagtttgggtttcgggttttaagtttaccggttttaaacttagttaccgttaacgggggttaaaccctttcgggttaacccccggg

SEQ ID NO: 438415 - DNA, 595 bp, Homo sapiens
  misc_feature: GZ8MTXP01BGQ1L.44.36.D03.1.454.CMB.2.raw
  modified_base (375)..(375): a, c, t, g, unknown or other
  modified_base (577)..(577): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatagaacgaaaaatcctaacagtacatctctagaagagctagtttaaccatctaccaaggacacctaccgaaaaggcaggttgtactttaagtatacgaccaacagtcggaccctgcgacaccgaggcaacatattaacngtgacgtaacgggtaatggaacgggaaagaaacgtagtcgttgttactagttattataacgttacttactatcgtaggacgtggtagggacgaaacgggggtaccacggtccaccgtctccgtcgacgcctaccaccgacggcccacgtccgtcccgttccccgtggcccgtccctgccgttcgacggcgcccaacgtcggnggggccaacggcgtccgg

SEQ ID NO: 438416 - DNA, 656 bp, Homo sapiens
  misc_feature: GZ8MTXP01CARRY.44.36.D03.1.454.CMB.2.raw
  modified_base (359)..(359): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaacgaaaaatcctaacagtacatctctagaagagctaagttaaccatctaccaagacacctacaaaggcaggtgtactttagtatacgaccaacagtcggaccctgcgacaccgaggcanatacttaactgtgacgtaacgggtaagtcgggaacgggaaaagaaacacgtcgtttggtttacttaggtaatttaagttaacgttacttaccagttcgtgggtaacgttcgtagggggaccaaacgggggggaccctacggggtacccacccggttcctccctcgacgtccctacccgaaccgaaccggggtcccctacggttcccggtccccttccccgtcgggcccgtccccttcgcccgttcccggaggtaaccgccgtaacccgtcgggcggggacctaacgcggtccccggg

SEQ ID NO: 438417 - DNA, 668 bp, Homo sapiens
  misc_feature: GZ8MTXP01B501H.44.36.D03.1.454.CMB.2.raw
  modified_base (272)..(272): a, c, t, g, unknown or other
  modified_base (284)..(284): a, c, t, g, unknown or other
  modified_base (318)..(318): a, c, t, g, unknown or other
  modified_base (604)..(604): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcagttggtggaggtccgggggagtacgttggtccagccgtggagggtccctgagactctcctgtcgtcncctgtgatcacntcagtcacctactatagtcggacgtcgggtcccnccgaggctaccggagggggtaacggggcgtgggaggttcggcggttcgggacccgtaaccgtaaaacggttaaaaaaacgtaaggtttaccgacccgtaaagttacccttttaagaccaaacgacggtacgtaccggcccggtcgtactaggtagaaacgcagtacttcacttcctactacaagtacgtaatacgtaaccttacgaaacgtaacttcctagttagtacttcgagtaccgtaatacgtaaacctaaaccgtaacggaaaaccggaggaacgacgggntacgttagttaagtttgttgttgtttgttaagtttaactagttacgtaacggttaacgttccgg

SEQ ID NO: 438418 - DNA, 790 bp, Homo sapiens
  misc_feature: GZ8MTXP01EE89U.44.36.D03.1.454.CMB.2.raw
  modified_base (213)..(213): a, c, t, g, unknown or other
  modified_base (509)..(509): a, c, t, g, unknown or other
  modified_base (521)..(521): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgttattttacaaggtgtccagagtgaagtgcaggttggnggaggtccggggatacgttggtccagccgtgggacgggtccctgacgactctcctgtcgtcgcctgtggactcacatcaagtcgaccactatagtggactcgggtcccgccgaggtcctaccggaagggggaacgggggtcttagggggaggttcgggtcgttcggggacccgtaaacgaaaacggttaaaaaaaacgtaaggtttcgacccctaaaggttaccttttaagaccaacgtaaggtacgtaccgccgtacgttcgtagtaagaaacgccaagtacttacccaaccctntaacaaaggtanaacgttacgtaaaccttaacgaaacgggtaaccttagtaaagtttgaaactttccggtagaacgttaaaacgttaccggtaaaacccttaaaaccggtaaacgggaaaaaacccgggaacgggtaaaccggaaacccgggggttacttaaaggtttaagggtttaaattttaaaggttttgggtttaagttttaaccggggtttaatttttaaaccgttaaggttaccggttaaaacgggttaacccgttttcgggttaaaccccgggg

SEQ ID NO: 438419 - DNA, 647 bp, Homo sapiens
  misc_feature: GZ8MTXP01BJMRU.44.36.D03.1.454.CMB.2.raw
  modified_base (390)..(390): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagcttgggttttccttgttgttattttacaaggtgtccagagtgaagtgcagttggtggaggtccgggggagacttggtccagccgtggagggtccctgagactctcctgtgtcgctctggatcacatcagtcgaccactatagtggactcggggtcccgcgaggcctaccggagggggaacggggctgggagttggcgtggccgacaagtaaaaacagttgcctaaagtctttaancaacaggacgtaccgccgcgttcgtagtacgaaacggcccaagtacttcccaccctctacgaagagatgtaacttacaaaggtaacttcgtaatttggaactttccaggtacctaaagttcgtaaacccgttaaaccgtaaccgggaaaaacccgggaacgggaaccgacggggtaccttaaggttaggttaattttaggttgtttggtttaagttagttttaatacgtacgttacgggtaacttcggtaaccccgg

SEQ ID NO: 438420 - DNA, 616 bp, Homo sapiens
  misc_feature: GZ8MTXP01DEF77.44.36.D03.1.454.CMB.2.raw
  modified_base (273)..(273): a, c, t, g, unknown or other
  modified_base (311)..(311): a, c, t, g, unknown or other
  modified_base (392)..(392): a, c, t, g, unknown or other
  modified_base (528)..(528): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcaggttggtggaggtccgggggagacgttggtccagccgtgggacggtccctgagctctcctgtgtcgcctntggatcaccatcagtgaccatatatggactgggtcccnccaggcctaccggagggggaaggggctgggagtcggcttgggccgacaaaggtaaaaaacagttgccctaaagtctttaancacgagacgtaccgccgcgtctagtagaaacgccagtacttaccgaccctctacaaagagatcgtaacttacgaaaggtaacctctaattgattcgagtacgtaaatcgtaaacctaaaccgtacgaaaacccggngggaaaccgacggggtacaagttggtaattttagttgtttaggtttgtttagtttaatagtacgttaggttaacttcggttaacccgg

SEQ ID NO: 438421 - DNA, 605 bp, Homo sapiens
  misc_feature: GZ8MTXP01D0JJV.44.36.D03.1.454.CMB.2.raw
  modified_base (192)..(192): a, c, t, g, unknown or other
  modified_base (225)..(225): a, c, t, g, unknown or other
  modified_base (237)..(237): a, c, t, g, unknown or other
  modified_base (285)..(285): a, c, t, g, unknown or other
  modified_base (317)..(317): a, c, t, g, unknown or other
  modified_base (340)..(340): a, c, t, g, unknown or other
  modified_base (375)..(375): a, c, t, g, unknown or other
tcagacagtatatacacgaccggtgctcgatttagctgcgtcacgatctctcttggggggggtcacaagaggcagcgctctcgggacttctccaccatggcctgggctctgctgctcctcactctcctcacccaggacacagggtcctgggcccagtctgccctgactcagcctgcctccgtgtctgggtcncctggacagtcgtcaccatctcctgcactgganccagcggtaatnttcttagtcttaactttgtctctgtatcaacatcatccaaggtaaacnccccaaactcatcatctatgagcctaataagngccctgagggtttctaactcgtnttcactgaccctcaagtccgacaacacggcctccngactatctcgtgggctcgaggctggacggtacgaggctagtatttattagtttgttgtctacgagtagttcggttcgtcgtctattctaactttagttcggtttccgttaggggtaaacggttcggggtaaacccgtaacgggttcccgttacccggttacccgttaacgggttacccaaccggtacccccgaaacgggttacccccaaacccccgttcgtttaacccgg

SEQ ID NO: 438422 - DNA, 732 bp, Homo sapiens
  misc_feature: GZ8MTXP01ASHDM.44.36.D03.1.454.CMB.2.raw
  modified_base (289)..(289): a, c, t, g, unknown or other
  modified_base (408)..(408): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcgagttgggtgggaggtccgggggagtacgttggtccaggccgtggagggtccctgagacctctcctgtgtcgcctctggatcaccntcagtgaccactatagtggacgtcggtccgaccgaggcctccggagggggaagggggcgtagggagtggcgttcggaccgacgaaaggtaaaaacgaaggttcgacctaagtctttaanccaacgtaggacgtaccgcccgtcgtacgtggaagtaaaccggcctaagtaccttccccaaccccgttactacgaaaggtagtaacgttacggtaacctttaaccgaaaacgggttaaacccttcgttaaagtttacggtaaacttttcccgaggtaacccgtaaaagttcccggtaaaacccttaaaaccgtaaccgggaaaaaacccggaacgggtaacgggttaccggggtacttaaaggtttgtttaagtttagtttcggttaggttttaagttggttttaaactacgtacggttaacgggtaacttccgggtaacccgg

SEQ ID NO: 438423 - DNA, 639 bp, Homo sapiens
  misc_feature: GZ8MTXP01EI6KP.44.36.D03.1.454.CMB.2.raw
  modified_base (218)..(218): a, c, t, g, unknown or other
  modified_base (308)..(308): a, c, t, g, unknown or other
  modified_base (358)..(358): a, c, t, g, unknown or other
  modified_base (389)..(389): a, c, t, g, unknown or other
  modified_base (454)..(454): a, c, t, g, unknown or other
  modified_base (506)..(506): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagccgtggagggtccctgagcttctcctgtgtcgcctctggattcaccatcagtcgaccatatagtggacgtgggtcccnccgaggcctaccgagggggaaggggctgggaggtgggcttcgggaccganaaagtaaaaacaagttcgacctagtctttancaaacgagaacgtaccgcccggcttacgtagtacgaaacgccctaagtactttacccaacccctntaacgaaagtagtagttacactttacaaagtaactatacgtttgaatttcgngagtaaatcgaaacctaaacgtaggaaaacccgtggaacgtcgggataagttgttagttagtttggtagtttgttagtttattactaacgtagggtaacttcggtaccacgggttcgggggcctaaaccgggg

SEQ ID NO: 438424 - DNA, 637 bp, Homo sapiens
  misc_feature: GZ8MTXP01AM8S5.44.36.D03.1.454.CMB.2.raw
  modified_base (278)..(278): a, c, t, g, unknown or other
  modified_base (401)..(401): a, c, t, g, unknown or other
  modified_base (458)..(458): a, c, t, g, unknown or other
  modified_base (499)..(499): a, c, t, g, unknown or other
  modified_base (537)..(537): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtgggacgggtccctgagactctcctgtgtcgcctntgatcacatcagtcgaccactatagtggacgtcgggtccgccgaggcctccggagggggaaggggcgtgggagtggcttcgggccgaccaaagtaaaaacgaagttcgacctaagtctttaancaacgagacgtaccgccgtcgtactgtaagaaacgcccaagtacttccgaacccctntacgaagagatcgacttacaaaggtactctattcgattcgngacgtaaatcgtaaacctaaacgtaacggaaaaccggnggtaaccgacgggtacttaagttagttaatttagtttgttaggttttaagtttagtttaacgtacgttacggttaacgggtaaccttcgggtaaccccgg

SEQ ID NO: 438425 - DNA, 628 bp, Homo sapiens
  misc_feature: GZ8MTXP01DI9F1.44.36.D03.1.454.CMB.2.raw
  modified_base (392)..(392): a, c, t, g, unknown or other
  modified_base (442)..(442): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcagttggtggaggtccgggggagacgttggtccagccgtggacgggtccctgagactctcctgtgtcgctcgtggatcacatcagtgaccactatatggactgggtcccgccgaggctaccgaggggaagggggctgggagtggcgttggccgacaaaggtaaaaacaagttgacctaaagtctttaancaacgagacgtaccgccgtcgtactgtagaaacgccagacttccaccctntacaagagatgaacttacgaaagtaactctaattgacttcgtgacgtaaatcgtaaacctaaccgtaaggaaaacccgaagggaaaccgacggggtacttaaagttacggtaatttagtttgggttagttttaacgggttatttaattacgtaccgttaaaggggtaaccttcgggttaaccccgg

SEQ ID NO: 438426 - DNA, 705 bp, Homo sapiens
  misc_feature: GZ8MTXP01ELZ78.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcagttggtggaggtccgggggagtacgttggtccaggtccgtgggacgggtccctgacgactctcctgtgtcgctctggatcacatcagtcgacctactatagtggacgtgggtccgcaggctcgaggggagggctgggagtcgggcttcgggccgaacaaacggtaaaaaacaagttcgaccctaaagtactttaagctaacgacggacgtaccgccgtacgttctagtacgaaaacgccaagtacttacccaaccccttatacaaagagaatacgtaacttacaaaaggtaccttactaagtttcgaactttcgtcgtaacgtaaacgtacggtaaaacccttaaaccgtaaacgggaaaaaacccccgggaagggaaaccccgttaaaccgggggtacttaaaggttttaacggtttaatttaaggttttgggtttaggtttttaagtttagttttaataacgttacgttaacggggttaacctttcgggtaaccccgg

SEQ ID NO: 438427 - DNA, 848 bp, Homo sapiens
  misc_feature: GZ8MTXP01B83JW.44.36.D03.1.454.CMB.2.raw
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtggaggtccgggggagtacgttggtccagccgtggacggtccctgacgctctcctgtcgtcgctntgactcacatcagtcgaccactatagtggacgtcgggtccgcgaggctaccggagggggagggcgtgggagtggcttggaccgacgaaaggtaaaaactaaggttcgacccgtaaagttaccttttaagaccgtaaacgtagggtaacgtaccggacccggtcgttacgtaggtaacgaaaacggtccctaaggtaacctttcccgaaaccccctttgtaaacgaaaagggtacgtaaacttacggttaaacctttaaccgaaaaacggggttaacctttacctaaagttttaggtaacctttttacggaacgggtaaacccggttaaaaagttaccggtaaaaaccccgtttaaaaacccggtaaaccggggaaaaaaaccccggggtaaacgggggaacccggttaaacccggggggtaacttaaaggtttttaaacgggttttaacgtttttaaagggttttttcgggtttaaggggtttttaagggtttttaacgttttttaaattaaacggtttacccgggttaaaacggggtttaaaccccgtttcgggggtttaaacccccggg

SEQ ID NO: 438428 - DNA, 675 bp, Homo sapiens
  misc_feature: GZ8MTXP01DJSD3.44.36.D03.1.454.CMB.2.raw
  modified_base (305)..(305): a, c, t, g, unknown or other
  modified_base (370)..(370): a, c, t, g, unknown or other
  modified_base (546)..(546): a, c, t, g, unknown or other
  modified_base (563)..(563): a, c, t, g, unknown or other
tcagacagtatatacacgaccggtgctcgatttagctgcgtcacgatctctcttggggggagagcggagcccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacttggtccagcctggagggtccctgagactctcctgtgtcgcctctggattcaccatcagtgaccatatatggactgggtccncaggcctcgagggggagggctgggagtggctggccgacaagtaaaacaagttcgccagtctttancgaaacaggaacgtaccgccgtcgtctggtacgaaaacgtcccaagtactttcccgacccttctacaaaggacgtaatcgaacccttacgaaagaaccttcaagttttggggaactttccgaagacccggtaaaattcggaaacccttaaacccgtaaacggaaaaaaccccgggnggaaaccgaccggggtntaaagttggttaactttagttggttgtttacggttagttttaattagttaacccggaaagggttaaccttcgggtaccccgaggttccggggggaaccccgtaaaccggggg

SEQ ID NO: 438429 - DNA, 669 bp, Homo sapiens
  misc_feature: GZ8MTXP01A50XB.44.36.D03.1.454.CMB.2.raw
  modified_base (228)..(228): a, c, t, g, unknown or other
  modified_base (321)..(321): a, c, t, g, unknown or other
  modified_base (377)..(377): a, c, t, g, unknown or other
  modified_base (418)..(418): a, c, t, g, unknown or other
  modified_base (486)..(486): a, c, t, g, unknown or other
  modified_base (540)..(540): a, c, t, g, unknown or other
  modified_base (584)..(584): a, c, t, g, unknown or other
  modified_base (597)..(597): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttatttttacaaggtgtccagagtgaagtgcaggttggtggaggtccggggganacgttggtccagcctgggagggtccctgagactctcctgtcgtcgcctctggatcacatcagtcgaccactatagtgggacgtcggggtcccnccgagggcctaccggaagggggaacgggggctggggagtgggcttggggacccganaaacggtaaaaaacaaggttcgaccctaaaggttctttaanacctaacgaaggtacgtaccggccgtcgttactggtagaaacggccctaagtacttcccaaccccttntacaaaggacagttacgaacctttacaaaggtaacttcgtatttacgatttccngtaaccgaaattcgtaaaccttaaacccgaaggaaaaacccggngaaccgacgggtnttagttaggttatttagttggttagtttggttagttttaatacgtaccgagggtaactttcggtaaccccgg

SEQ ID NO: 438430 - DNA, 613 bp, Homo sapiens
  misc_feature: GZ8MTXP01E2AEC.44.36.D03.1.454.CMB.2.raw
  modified_base (227)..(227): a, c, t, g, unknown or other
  modified_base (315)..(315): a, c, t, g, unknown or other
  modified_base (376)..(376): a, c, t, g, unknown or other
  modified_base (391)..(391): a, c, t, g, unknown or other
  modified_base (519)..(519): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccggggganacgttggtccagccgtggagggtccctgagactctcctgtgtcgcctctggatcaccatcagtgaccactatagtggactgggtcccnccaggcctaccggaggggacgggctgggagtggcttggccacaaagtaaaaaacaaggttncccaaagtctttaancaacgagagtaccgcgcgtctgagaaacgccagacttcaaccctctacaaagacgatagaacttacaaaggtaacttctagttagacttctagacgaaattcgaaaccttaaaccgaggaaaaaccgngggtaacacggggacttagttggttaaatttaggtttggttagtttggttattttaagtacttacggttaagggtaacccttcgggtaaccccg

SEQ ID NO: 438431 - DNA, 641 bp, Homo sapiens
  misc_feature: GZ8MTXP01DR4U0.44.36.D03.1.454.CMB.2.raw
  modified_base (295)..(295): a, c, t, g, unknown or other
  modified_base (339)..(339): a, c, t, g, unknown or other
  modified_base (365)..(365): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccgaggggagacggccaggattaccgtggtgggggcgacgccggttggaggtaaagtgacagtggtacagcagagcaggcagaccctgtgctggtcatctatangatggccgggccggccctgagtgactcccgtgcgcgtcttcccnccggctccaactcgtaacgggaaccncggcccacccgtagacccatcgaggcgaggggtcggaggggccggggagtcggaacggaccggtacttaagttaccgtgtacgaagtcgtagggtaggggggaactaagggttaaggtagtaggtactacgtaacgttccccgggttaggttacgttccggggacggggaacgggaaccgtaagggccgtacgggacccgtccggtcgggttaccgacggttacccgaacggccgtcccggcccccgtcgggttccctaaccgttcccgttccccg

SEQ ID NO: 438432 - DNA, 753 bp, Homo sapiens
  misc_feature: GZ8MTXP01D658Y.44.36.D03.1.454.CMB.2.raw
tcagacagtatatacacgaccggtgctcgatttagctgcgtcacgatctctcttgggtcttgtcccatgtcaccttgaaggagtctggtcctgtgctggtgaaacccacagagaccctcacgctgacctgcaccatctctgggttctctctcaacgatattagaatgggtgtgagctggatccgtcacgcccccgaggggaacggccctgggagtggcttgcacacatcttctcgaatagaacgaaaaatccctaacagtacatctactagaagagactaagttaaaccatcctaccgaaggaccacctaccgaaaaggcgtagggtggttactttagtatacgaaccaacagtacggaccctgaccggaccacgaggcactataattactggtagacgtaacggggtaatcgggaacgggaaaagaaaccgtagtcgtttagggtttactaggttaatttaacgttaaacggttaccttaacctacgtacgtacgggacggttacggtacgggggtaacggaaaacggggtacccgtaaccgggtaccgtaacccggttcctacccgtaccgtaaccggtcccttaacccgaaccccggtaaaccgggccccgtaacgtttccccgggttccccgtttcccccggttccgggtccccggtcccccgttcgttccccgttacccggaacgggtaccgcccgttaacccggggtccggttaccggggggtaacccaaccgggtaaccccggggg

SEQ ID NO: 438433 - DNA, 764 bp, Homo sapiens
  misc_feature: GZ8MTXP01AFUXU.44.36.D03.1.454.CMB.2.raw
  modified_base (273)..(273): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacatcttctacgaatagaacgtaaaactcctacagtacatctactagaaganactacgttaaccatcctaccaaaggacctaacccgtaaccgaaaaggtcgtaaggggttggtttactttaagtactacggaaccctaaacgtacgttacggaccccgtggaccgaaccaccgaacggacaacctaattacgtttaaaccgtgttaacggaccggtaaacggggtaacgtacggggaaacgggggtaaaacaaaccgtaggtacgtttacggttttacgtaaggttaattaaacgttaacgtttaccttacctaagttccgttacgggaccgttcggtacgggggaacgaaaccgggggtccgaccgggttacccacccggttcctcccgtacgtacgtcccgttacccaaccgggtaaccgtccccgtaacgttccccgggtaccctttcccccggcggcccgtccccggtgccccgttaaccgcgggtaacccggtcttaaccccggcggggtcgggacctaaccggccgggtccccggg

SEQ ID NO: 438434 - DNA, 643 bp, Homo sapiens
  misc_feature: GZ8MTXP01DIZ7W.44.36.D03.1.454.CMB.2.raw
  modified_base (382)..(382): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccatatatggactgggtccgccaggctccgaggggaacggggctgggagtggcttggccgacaaagtaaaaaacaaagttcgccaaagtctttaancaacgaagacgtaccgccgcgtctagtagaaacgccaagtacttacccaaccctctacgaaagagtatacgtaaccttaacgaaacggtaaccttctaaagttacgtatttcgtaggaacgtaaaatcggtaaaacccttaaaaccgtaaacggaaaaacccggaacgggaaccgaaaccggggtacttaagtttaggttaattttagtttggttagtttggttaagtttaagtactacgaaggtaacgttcggtaacccg

SEQ ID NO: 438435 - DNA, 626 bp, Homo sapiens
  misc_feature: GZ8MTXP01DLYST.44.36.D03.1.454.CMB.2.raw
  modified_base (271)..(271): a, c, t, g, unknown or other
  modified_base (385)..(385): a, c, t, g, unknown or other
  modified_base (586)..(586): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctntggatcaccatcaagtgaccactatatggactgggtcccgcaggctccgagggggaagggctgggagtggcttggccgacaaggtaaaaacaagttcgcccaagtcttttaacncgaacaggacgtaccgcgtcgtctaggtagaaacgccgaagtacttcccaaccctctaacaaagagactacgacttacgaaacgtaacttctaagtttacgacttccgtagaaccgtaaagtacgtaaacccgtaaacctacggaaaaaccggaaggaacgacgggtacttaagttaggttaatttagtttgttaggtttnttagttttaatacgtacgttaaggtaacgttcggtaaccg

SEQ ID NO: 438436 - DNA, 688 bp, Homo sapiens
  misc_feature: GZ8MTXP01BKYLA.44.36.D03.1.454.CMB.2.raw
  modified_base (280)..(280): a, c, t, g, unknown or other
  modified_base (320)..(320): a, c, t, g, unknown or other
  modified_base (420)..(420): a, c, t, g, unknown or other
  modified_base (441)..(441): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgttattttacaaggtgtccagagtgaagtgctaggttggtggaggtccgggggagtacgttggtccagccgtgggacgggtccctgagactctcctgtgtcgcctntggatcacatcagtgaccactatagtggactggggtcccnccgaggcctaccggagggggaacggggctggggagttcgggcgttcgggacccgtaacgaaaggttaaaaaacaaggttcgacccgtaaagtcctttaanccaaacgagacggtacgccgngttcgtagtaacgaaactccgaagtacttcccaaaccccttctacgaaagacgtatacggtaacttacgaaaggtaacttacgtaagtttacgtacttcgtcggtaaccgtaaatacggtaaacccttaaaccgtaaacgggaaaacccggaaggtaaccgaaccgggtacttaagttacgttaatttagtttggttgttttaagttagttttaatacgtacgttaagggtaaccttcggtaacccg

SEQ ID NO: 438437 - DNA, 576 bp, Homo sapiens
  misc_feature: GZ8MTXP01DCX3H.44.36.D03.1.454.CMB.2.raw
  modified_base (245)..(245): a, c, t, g, unknown or other
  modified_base (285)..(285): a, c, t, g, unknown or other
  modified_base (289)..(290): a, c, t, g, unknown or other
  modified_base (298)..(298): a, c, t, g, unknown or other
  modified_base (317)..(317): a, c, t, g, unknown or other
  modified_base (343)..(343): a, c, t, g, unknown or other
  modified_base (351)..(351): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctgactcaggacacagggacctgggcccagtccgcctgactcagccagcctcgtgtctgggtctcctggacagtcgctccacctctcctgcactggaactatactgatgttagaaatntaactgtctctgacaagtataccacgtaaccccaactctnttannagtacaanagcgacctcggctatttcnctatcgcttctcacggctacaagtcnggacaacncggcctgtagtatattctcggcctctacgccgtacgacgacgacgaccgacttattatcgctgactcaagttacgtggtaccggtccgtaagtacgttacgttgggttacttcgggggacggtacggggtacccgtcgtaacggcccgttcgtacggttcgacggcccgaggcccttccggtcccctgggtcctaccgttccttccgttccccaaccgtttcccc

SEQ ID NO: 438438 - DNA, 645 bp, Homo sapiens
  misc_feature: GZ8MTXP01AB2X6.44.36.D03.1.454.CMB.2.raw
  modified_base (210)..(210): a, c, t, g, unknown or other
  modified_base (225)..(225): a, c, t, g, unknown or other
  modified_base (419)..(419): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggnggaggtccggggganacgttggtccagcctgggacggtccctgagactctcctgtgtcgcctcgtggactcaccatcagtcgaccactatagtcggacgtcggggtcccaccgagggcctaccggagggggaacggggcgtggggagtcgggcgttcggggaccctacgaaaaggtaaaaacgaagtttcgaccctaaagtcctttaancaacgagacgtaccgccgtcgtactggtacgaaagcccaagtacctttacccaacccctctaacgaagtagattacggaaccttacaaaagggtaactcgttaattacgtacttctagacgtaaatcggtaaaccttaaaccgaacgaaaacccggaagacccgagggacttagtgttaattgttggttattcgttagttaacatcgttagtaacttggtaacccg

SEQ ID NO: 438439 - DNA, 627 bp, Homo sapiens
  misc_feature: GZ8MTXP01B6MQ7.44.36.D03.1.454.CMB.2.raw
  modified_base (313)..(313): a, c, t, g, unknown or other
  modified_base (390)..(390): a, c, t, g, unknown or other
  modified_base (450)..(450): a, c, t, g, unknown or other
  modified_base (486)..(486): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacttggtccaggccgtgggagggtccctgagactctcctgtgtcgctctggatcacatcagtgaccactatatggactgggtccnccaggctccgaggggagggctgggagtggcttgggccgacaaaggtaaaaaacaagttcgacctaagtacttttaanacaacgaggtacgtaccgccggtcgtcgtagaagaaacgcctaagtacttcccaaccctntaacgaagagtatagtaaccttacgaaaggtacttntaattacgtacttcgtagaactaaagtacgtaaacctaaaccgtaacggaaaaccggaaggaaccgacgggacttagttagttattagtttgttgtttaagttagtttaatacgtacgttaacggtaacgttcggtaaccg

SEQ ID NO: 438440 - DNA, 757 bp, Homo sapiens
  misc_feature: GZ8MTXP01AX72S.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatagaacgaaaatcctacagtacatctctagaagagactagtttaaccatcctaccaaggaccacctaccgaaaaggcgtaggtaggttctttaagtatacgaacccaacagtacggaccctggaccggacaccgacggacaactaacttattaaacgtgtcggacgtaacggggttaaagtacgggaaacggggaaaacgaaaacgtaggtaccgtttagggtttacttaggtttaaacgtttaattaaacggtttacccttaacctaacgttaccgttacgggtaccgttcgggttacgggggaaccggaaacggggggaacccgtaaccggggtaccctaacccggttccttaccctaccgaacggttccccttacccgtaacccggaaccggggtacccctaaccggttcccggttccccgtttcccccggtcggccccgtccccgttcggcccttaccggacggtcgcccgtaacccgggttccggacggggggacctaaccgggccggtccccgggg

SEQ ID NO: 438441 - DNA, 527 bp, Homo sapiens
  misc_feature: GZ8MTXP01DNIDG.44.36.D03.1.454.CMB.2.raw
  modified_base (282)..(282): a, c, t, g, unknown or other
  modified_base (313)..(313): a, c, t, g, unknown or other
  modified_base (336)..(336): a, c, t, g, unknown or other
  modified_base (359)..(359): a, c, t, g, unknown or other
  modified_base (415)..(415): a, c, t, g, unknown or other
  modified_base (489)..(489): a, c, t, g, unknown or other
  modified_base (493)..(493): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccgaggggagacggccaggattaccgtggtgggggcgacgccggttggaggtaaaagtgtacagtggtacagcagagcaggccagccctgngctggtcatctatatgatgcgggccgccctnagtgactccctgcgcgccttccnccggctccactcgtacgggaacncggccaccctgacccatcagcagggtcgagggccgggatggacggccgatattacngtcagtcgtggtgggggactaggtagtagtgatcgagttccgtgtagtcggcggaggaaccaagctgccgtcgnggcncgaccgaaggctcgcccctgcctcgttcgtcccg

SEQ ID NO: 438442 - DNA, 621 bp, Homo sapiens
  misc_feature: GZ8MTXP01DMU4Z.44.36.D03.1.454.CMB.2.raw
  modified_base (307)..(307): a, c, t, g, unknown or other
  modified_base (382)..(382): a, c, t, g, unknown or other
  modified_base (446)..(446): a, c, t, g, unknown or other
  modified_base (469)..(469): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggatcaccatcagtgaccatatatggactgggtccnccaggctccgaggggaaggggctgggagtggcttggccgacaaggtaaaaaacaagttcgaccaaagcttttaanacaacgaagacgtaccgccgtcgtctagtagaaacgccaagtacttaccaccctctacaaaganatcgtaacttacaaaggtaactntaattagtaatttcgtagaacgtaaatacgtaaaccctaaaccgtaaacggaaaaacccggaagggaaccgacggggtacttaagttagttaatttagtttggttagtttgttacgttttaatatacgttaaggtaaccgttcggtaacccg

SEQ ID NO: 438443 - DNA, 625 bp, Homo sapiens
  misc_feature: GZ8MTXP01EQ1Z4.44.36.D03.1.454.CMB.2.raw
  modified_base (313)..(313): a, c, t, g, unknown or other
  modified_base (390)..(390): a, c, t, g, unknown or other
  modified_base (443)..(443): a, c, t, g, unknown or other
  modified_base (479)..(479): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcaggttggtggaggtccgggggagtacgttggtccagccgtgggagggtccctgagctctcctgtgtcgctctggatcaccatcagtcgaccactatagtggactgggtccncaggctccgagggggagggcgtgggagtggcgttggccgacgaaaggtaaaaaacaagttgaccctaagtctttaancaaacagacgtaccgccgcgttactgtagaaacgtccagtacttccacccctntacaaggatatacgtaacttacgaaaggtaaccttntaattgtattcgtgacgtaaagtcgtaaaccttaaaccgaacggaaaacccgggaaggaaccgacggggacttagttaggttaatttagtttggttgtttggttacttttaagtatacggttaacggtaacgttcggtaaccccgg

SEQ ID NO: 438444 - DNA, 829 bp, Homo sapiens
  misc_feature: GZ8MTXP01BLWUF.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgtagttggtggaggtccgggggagtacgttggtccagccgtgggacggtccctgagactctcctgtcgtcgcctgtgactcacatcagtcgacctactatagtggacgtcgggtcccgccgaggcctaccggagggggaacgggggcgtaggggaggttcgggcgttacgggaccccggtaaccgtaaaacggttaaaaaaacgtaaaggttcgacccgtaaacggttacctttttaacaccgtaaaccgtaagggtaaccggttaccggcccggtcgttaccgttaggtaacggaaaaccgcccgtaaagtaccctttaccccgaaacccccttacgtaaccgaaaggtacgtaagttacggtaaacctttacggaaaacgggtaaccctttacgtaaagttttcgaacttttccgaggtaaccgttaaaagttccgtaaaacccgtttaaaaccccgaaacgggaaaaaacccgggtcggggaaacccgttacccgggggtaacttaaaggttttaacgggtttaaactttttggttttacgggtttggtttttaaggtttacggttttttaaatacggttacggttaaacgggttaaccctttaacggggttaacccccggg

SEQ ID NO: 438445 - DNA, 610 bp, Homo sapiens
  misc_feature: GZ8MTXP01D7KCX.44.36.D03.1.454.CMB.2.raw
  modified_base (223)..(223): a, c, t, g, unknown or other
  modified_base (295)..(295): a, c, t, g, unknown or other
  modified_base (522)..(522): a, c, t, g, unknown or other
  modified_base (579)..(579): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagctgggttttccttgttgttatttacaggtgtccagagtgaagtgcagttggtggaggtccggggganacgttggtccagcctggagggtccctgagctctcctgtgtcgctcgtgatcaccatcagtgaccactatagnggacgtcgggtcccgccaggcctccggagggggaacggggctgggagtggcgttggacccgacgaaaggtaaaaaacaagttcgaccctaagtctttaagcaacgagacgtaccgccgcgtctagtagaaacgccaagtacttcccaccctctacgaagagactgaacttacaaaggtactcattacgattctagacgaatcgaaaccttaaaccacgaaaaccggngaacgaccgggtacttagttagttaatttagtttggttagttttgtacgtttttaanagttaccgttagggtaaccttcggtaacccg

SEQ ID NO: 438446 - DNA, 588 bp, Homo sapiens
  misc_feature: GZ8MTXP01AQN1W.44.36.D03.1.454.CMB.2.raw
  modified_base (306)..(306): a, c, t, g, unknown or other
  modified_base (346)..(346): a, c, t, g, unknown or other
  modified_base (378)..(378): a, c, t, g, unknown or other
  modified_base (432)..(432): a, c, t, g, unknown or other
  modified_base (500)..(500): a, c, t, g, unknown or other
  modified_base (510)..(510): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccgtggagggtccctgagactctcctgtgtcgcctctggattcaccatcagtcgaccactatatggacgtgggtcccnccaggcctccgaggggagggctgggagtggcttggccganaaagtaaaaacaagttcgacctagtctttaancaaacagaacgtacgccgtcgtcgagtagaaacgcccaagtacttccacccttnacaagagatgactacgaaagtactcgtattggatttcgtgacgtaatcgaactaaccgagaaaaccgngaacacgggntaagtgttattagttgttgttgttgtttattataacgacggtaacttcggtccgacgggtcgggaacccgtaaccggg

SEQ ID NO: 438447 - DNA, 662 bp, Homo sapiens
  misc_feature: GZ8MTXP01C8UYY.44.36.D03.1.454.CMB.2.raw
  modified_base (210)..(210): a, c, t, g, unknown or other
  modified_base (276)..(276): a, c, t, g, unknown or other
  modified_base (487)..(487): a, c, t, g, unknown or other
  modified_base (526)..(526): a, c, t, g, unknown or other
tcagacagtatatacacgaccggtgctcgatttagctgcgtcacgatctctcttggggagctctgagagcggagccccagccccataattcccaggtgttttcatttggtgatcagcactgaacacagaggactcaccatggagttcgggctgagcttgggttttccttgtttgttatttacaaggtgtccagagtgaagtgcagttggnggaggtccgggggagtacgttggtccagccgtggacgggtccctgacgactctcctgtgtcgcctntggatcacatcagtcgaccatatagtggaccgtgggtccccgccgaaggtcctaccggagggggaacgggggtctgggggagttcgggcttgggcccgtaacgaaaacggtaaaaaaacgaagtttccgaccctaaaggtcttttaagcgaaaccaggacgtaccgccggtacgtctgtaagaaacgcccaagtaccttccaaaccccgtntaacgaaagtacgatacgtaacttacaaggtaaaccttntaagttgaacttcgtagtacgtaaagtcgtaaaccttaaaccgaaacggaaaaccggaacgaacgacgggtattagttagttaatttgttgttaggttgttagtttaatacgtcgttaagtaacgttcgtaacccg

SEQ ID NO: 438448 - DNA, 611 bp, Homo sapiens
  misc_feature: GZ8MTXP01BXSVH.44.36.D03.1.454.CMB.2.raw
  modified_base (294)..(294): a, c, t, g, unknown or other
  modified_base (479)..(479): a, c, t, g, unknown or other
  modified_base (521)..(521): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggaggtccgggggagtacgttggtccaggccgtgggacgggtccctgagactctcctgtgtcgcctctggatcacatcagtnaccactatatggactcgggtccgccgaggctccgaggggagggctgggagtggctgggccacgaagtaaaacaagttgacccaagtctttaagcacgagacgtacgccgacgtctgtagaaacgccaagcttccaccctctacaagagatcgaacttcgaaaggaacttcgtatttgaatttccnggacgtaaagttcgaaacccttaaacgtacggaaaacccggnggaaaccgacggggcttaaagttgtttaatttagtttggttggtttgttagttttaatacgtacgaacgggttaacttcggtaaccccgg

SEQ ID NO: 438449 - DNA, 685 bp, Homo sapiens
  misc_feature: GZ8MTXP01BAKQ2.44.36.D03.1.454.CMB.2.raw
  modified_base (320)..(320): a, c, t, g, unknown or other
  modified_base (412)..(412): a, c, t, g, unknown or other
  modified_base (480)..(480): a, c, t, g, unknown or other
  modified_base (579)..(579): a, c, t, g, unknown or other
  modified_base (599)..(599): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcaggttggtggaggtccgggggagtacgttggtccaggtccgtgggacgggtccctgacgtctctcctgtgtcgctcgtgatcacatcagtcgacctatatagtggactcgggtccnccgaggctaccggagggggaaggggctgggaggtcggcgttcgggaccgacgaaaggtaaaaaacgaaggttcgaccctaaagtcttttaancgaacgaggtacggtaccggcccgcgttactaggtaacgaaacgccgagtaccttcccaaccccgttnacgaaagtagatacgaactttacgaaacggtaccttataattcgtaactttcgagtacgtaaatacgtaaacccgttaaaccgaacggaaaaacccggnggaaacccggttaaccgggnttaaaggttaggttaattttaaggttggtttagtttaacggttgttttaaactagttacgaaacggtaaccgttcggtaaccccgg

SEQ ID NO: 438450 - DNA, 654 bp, Homo sapiens
  misc_feature: GZ8MTXP01DK3N4.44.36.D03.1.454.CMB.2.raw
  modified_base (227)..(227): a, c, t, g, unknown or other
  modified_base (314)..(314): a, c, t, g, unknown or other
  modified_base (338)..(338): a, c, t, g, unknown or other
  modified_base (557)..(557): a, c, t, g, unknown or other
tcagacagtatatacacgaccggtgctcgatttagctgcgtcacgatctctcttggggagctctgagagcggagccccagcccagaattcccaggtgttttcatttggtgatcagcactgaacacagaggactcaccatggagttcgggctgagcttgggttttccttgttgttattttacaaggtgtccagagtgaagtgctaggttggtgggaggtccggggganacgttggtccagccgtgggagggtccctggagactctcctgtgtcgcctctggatcacatcagtcaccatatatggactcgggtccncaggctacgagggggagggctggngtggctggccacgaagtaaaaacaagttcaccctaaagtcttttaagcgacaaggtacgtaccgccgtgtctagtacgaaaacgccgaagtactttaccccgaccccttactacgtaaaggacgtaatacggaactttacgaaagggtaacttctaatttaggactttcgtaggaccgtaaagttcgtaaaccttaaaccgaacggaaaaaacccgggngggtaaaccgcggggtacttaagttggtttaatttaagtttggttaggtttgttaagttttaataactacggttaaggtaaccgttcggtaacccgg

SEQ ID NO: 438451 - DNA, 671 bp, Homo sapiens
  misc_feature: GZ8MTXP01CTBA3.44.36.D03.1.454.CMB.2.raw
  modified_base (406)..(406): a, c, t, g, unknown or other
  modified_base (631)..(631): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccaggccgtgggacgggtcccctgacgactctcctgtgtcgcctctggattcacatcagtgaccactatagtggacctgggtccgccgagggcctaccggagggggaacggggcgtgggaggtgggtcgttgggaccgacgtaaagtaaaaacgaggttaccgccctagtacttttaanccgaaacgtacggaacgtaccggcccggtcgttcgtggtacgaaaacgccccgaagtacttccccacccttacgaccaaaggatacgtacgtaaccttacaaacgtaactcgtatttagggtattacgtagaccgtaaagtccgaaacctaaaccgtaacggaaaaccgtaagggaaccgtacggggactaagttaggttatttagttgttggttagttgtttanataagagtaactggtccgaggtcggggaaccgtaaccggg

SEQ ID NO: 438452 - DNA, 646 bp, Homo sapiens
  misc_feature: GZ8MTXP01BV38A.44.36.D03.1.454.CMB.2.raw
  modified_base (395)..(395): a, c, t, g, unknown or other
  modified_base (453)..(453): a, c, t, g, unknown or other
  modified_base (464)..(464): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccgggggagacttggtccagcctgggagggtccctgagactctcctgtgtcgcctctggatcacatcagtgaccactatatggactcgggtccgccgaggccgtccggagggggaaggggcgtgggagtggcttgggcccgacgaaaggtaaaaacaaaggttcgaccaagtcttttaanctaacgagacgtacgccgcgtctgtagaaagcccaagtacttccaccctctacaaganatgtaccttanaaacggtaacttctaattgtaacttccgtgtaccgtaaatacggtaaacctaaaccgtaacggaaaacccggaaggaacccgaacgggggacttaagttagttaaagttttagtttgggttaggttttaagttaggtttttaaatagttacgttaaacgggtaaaccttcgggttaaccccg

SEQ ID NO: 438453 - DNA, 565 bp, Homo sapiens
  misc_feature: GZ8MTXP01ALGMG.44.36.D03.1.454.CMB.2.raw
  modified_base (512)..(512): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctacagtacatctctgaagagcagttaaccatctccaaggacacctacaaagcaggtgtctttagtatgaccaacatcggaccctggacggacaccgaggacacatataactgtgcgaacgggtaatggacgggaaagaaacagtcttggttctagtattataagttacttacatcgtggacgtcgtaggggacaaacgggggcacggtcacgtcgtctcctcacgtccttccgaccgacggcccaacgtccggttcccttccccgnggcccgcccttcgccttccgaaggcgccaccgtcggttcggggcaacgccggg

SEQ ID NO: 438454 - DNA, 741 bp, Homo sapiens
  misc_feature: GZ8MTXP01CJV8N.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacgaaggtgtccagagtgaagtgctaggttggtggaggtccgggggagtacgttggtccaggccgtggacgggtccctggacgtacctcgtcccttgtcggtccgtcctcgtggtactccaccattcgagtcgaacctacgtaatagtggtacgtcggggtcccgcaggcctaccggagggggaaggggtcgtggggtacgtggcgttggggacccgtaacgtaaaacggttaaaaaaacgaaggtttcgaacccgtaaacgttacttttaacacgtaaaccgtagggtaacgtacccggcccgtacggttacctaggtaacgaaaaccggccgaagtactttacccaaccccttactaacgaaagtagattagtaccttaacgaaaggtaactacgtattcgtactttccgagtacgtaaatcgtaaaccgtaaaccgtaacggtaaaaccggaacggacgaaccggggtacttagtttaaagtttagtttaagtttggtttaggtttaagtttaggttttaatacgtacggttaaacgtaaccgttggttaaccccgg

SEQ ID NO: 438455 - DNA, 651 bp, Homo sapiens
  misc_feature: GZ8MTXP01BBWL8.44.36.D03.1.454.CMB.2.raw
  modified_base (272)..(272): a, c, t, g, unknown or other
  modified_base (284)..(284): a, c, t, g, unknown or other
  modified_base (439)..(439): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtggagggtccctgagactctcctgtgtcnctctggatcacntcagtgaccactatatggactcgggtccgcaggctccggaggggagggctgggagtggctggccagaaagtaaaaacaagttcgacctaaagtctttaagctaacgagacgtacgccgtcgtctgtacgaaacgtccaagtacttccaccccttnacgaagagactgtaaaccttacaaaggtaaccttgtaattacgtaactttccgaggactaaacgtgtaaaccccttaaaacgaacggaaaaaccggaacgggaacgaaaccggggtcttaaagttagttaagtttaagttgggtttaggttttaacgttaaggttttaattaacccgtacggttaaaggttaaccgttcggttaacccgggg

SEQ ID NO: 438456 - DNA, 606 bp, Homo sapiens
  misc_feature: GZ8MTXP01A9XAF.44.36.D03.1.454.CMB.2.raw
  modified_base (381)..(381): a, c, t, g, unknown or other
  modified_base (386)..(386): a, c, t, g, unknown or other
  modified_base (513)..(513): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccgtggagggtccctgagactctcctgtgtcgctctggatcaccatcagtcgaccactatatggactcgggtccgccaggctccgaggggaggggctgggagtggcttggccgacaaagtaaaaacaagttgaccaagtcctttaanacaanagacgtacgccgcgtctagagaacgccagtactcccaccctctacaaagagatacgtacttaacgaaacgtactctagttagtattcgagacgtaaatcgtaaacctaaaccgaacggaaaaccggnggaaccgacgggtattagttagttatttagttggttagtttaaggttacgttttaagtaacgtacgttaacggtaacccgttcggtaaccccg

SEQ ID NO: 438457 - DNA, 766 bp, Homo sapiens
  misc_feature: GZ8MTXP01EUH44.44.36.D03.1.454.CMB.2.raw
  modified_base (320)..(320): a, c, t, g, unknown or other
  modified_base (420)..(420): a, c, t, g, unknown or other
  modified_base (493)..(493): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgttgttattttacaaggtgtccagagtgaagtgcaggttgggtgggaggtccgggggagtacgttggtccagtccgtgggacgggtccctgagactctcctgtgtccgctctgatcacatcagtgacctactatagtggacgtcggtccnccgaggccgtaccggagggggaacggggtcgtgggaggtcggcgttgggacccgaccgaaaggtaaaaacaaaggtttcgaccctaaagttacttttaanaccaacgagtacgtaccgccggtcgttcctaggtacgaaaacgtccgaaagtcctttacccgaacccccgttntaaccgaaacggntaacttacggaaacctttaccgaaaagggtaacccttgtaactttcggtaactttcgacggtaaccgtaaaagttcccgtaaaccgttaaacccggtaaacgggaaaaaacccccgggaaggggtaaaccccttaaaccgggggtactttaaacggttaggtttaaatttttacggtttgggttttagtttgggtttaagttttttaaaccaaggtttacggaaacgggggtttaaaccctttccggggttaaaccccgg

SEQ ID NO: 438458 - DNA, 709 bp, Homo sapiens
  misc_feature: GZ8MTXP01ATL3R.44.36.D03.1.454.CMB.2.raw
  modified_base (290)..(290): a, c, t, g, unknown or other
  modified_base (305)..(305): a, c, t, g, unknown or other
  modified_base (389)..(389): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcacgccaccctcagtctcagtcggccccgaggggacgacggcgaggtacttaccgtggtgggggcgacgtccggttaggaaggtaaaagtgtacagtggacagcagacgcagccagaccctgngctgtcatctattangagtcggccgggcccggtccctgacgtcgacctccgtcgccgcgtccttcccgtccggcctaccgacctcgtaaacgggaaccnccggcccacccgtcgaccatacgacggcgacggggtcggacggggccggggagtacgggacgggtacccgtaacgtttaacgttaccgtcgtacgtaacggtccggttgggtaaccggggggtaacgtaaggggtttaacgtaggttacgtaacgtcgttaaccggttcccggggttaggttaccgggttaccggggaccggggtaaacgggaacccgtaaggttccggtacggttacccggtccgggtacgggttaccgccgacccggtaacggtcccgtccggtcccccgtcggttacctccgttcccgtttccccgg

SEQ ID NO: 438459 - DNA, 561 bp, Homo sapiens
  misc_feature: GZ8MTXP01EGQTU.44.36.D03.1.454.CMB.2.raw
  modified_base (318)..(318): a, c, t, g, unknown or other
  modified_base (339)..(339): a, c, t, g, unknown or other
  modified_base (363)..(363): a, c, t, g, unknown or other
  modified_base (426)..(426): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattaccgtggtgggggcgacgccggttggaggtaaaagtgtacagtggtaccagcagaagccaggccagacccctgtgctggtcatctattatgatgcgggccgccctnagtgatccctgcgcgcttccnccggctccaactcgtagggaaccncggccaccctgacccatcagcgagggtcgagggccgggggatggacggaccgtactattacgngtcgagcgtggtgggggactagtaggtagtgatcgacgtcccggtggtacgttcgggcgggagggaaccaagcgtcgaccgtcgtcgggttcgacgcccgaaggcctcgcccctggttcctaacgttcgttcccg

SEQ ID NO: 438460 - DNA, 620 bp, Homo sapiens
  misc_feature: GZ8MTXP01EE64N.44.36.D03.1.454.CMB.2.raw
  modified_base (338)..(338): a, c, t, g, unknown or other
  modified_base (369)..(369): a, c, t, g, unknown or other
  modified_base (420)..(420): a, c, t, g, unknown or other
  modified_base (451)..(451): a, c, t, g, unknown or other
tcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctggagggtccctgagactctcctgtgtcgcctctggattcaccatcagtgaccatatatggactgggtccgccaggctccgagggaaggggctgggagtggcttggccgnaaaggtaaaaacaagttcgccagctttaacncaaacagaagtacgccgcgtcgtagtagaaacgccaagtacttccaccctntacaaagacgatacgactacgaaagtaactntattcggtattcgagacgtaaatacgtaaacctaaacgtaaacgaaaaccggaggaccgtaacgggaactaagttagttaagtttagtttggttacgtttagttagtttaattacgtaagtaaagggtaaccttcggtaccaccggggttcggggaacccgtaacgggg

SEQ ID NO: 438461 - DNA, 626 bp, Homo sapiens
  misc_feature: GZ8MTXP01A65EW.44.36.D03.1.454.CMB.2.raw
  modified_base (224)..(224): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcgtcaccatctcctgcactgganccagtcgtaatattcttagtcttaacttgtctctgtatcacatcataccaaggtaacaccccaaatcatcatctatgacggtactaataacgacggtcctacgtagggtttctaacgtcgtacttcactcgaccctaccgaacgtcccgacaaccgccggtccctacccgtagacctaacttctacgtcgggtcctccgaggtaccgtaggacgggacggagtcgtagttatttaagtttagtttggttcgtactacgaagttcgttcgttacgtccgtactattacgttactttaggttcgttacggttacgggtaacggttacgggtaaaccgtacgggttacccgttccgttaccgtaagggtccaacggacccgacgacccctaacccgaacgttccg

SEQ ID NO: 438462 - DNA, 602 bp, Homo sapiens
  misc_feature: GZ8MTXP01A7HYX.44.36.D03.1.454.CMB.2.raw
  modified_base (307)..(307): a, c, t, g, unknown or other
  modified_base (386)..(386): a, c, t, g, unknown or other
  modified_base (391)..(391): a, c, t, g, unknown or other
  modified_base (421)..(421): a, c, t, g, unknown or other
  modified_base (437)..(437): a, c, t, g, unknown or other
  modified_base (550)..(550): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggagggtccctgagactctcctgtgtcgcctctggacttcaccatcagtcgaccactatatggactgggtcccnccgagggcctccggaggggaaggggctgggagtgggcttgggaccgagaaagtaaaaacaagttccgaccagtctttancaaanagtaacgtacgccgtcgtctggtagaaacnccagtactcacccctntacgaagacgatgaacttacgaataactactattggatttgtgacgaatgaaccttaaacgaacgaaaaccgaggacgacgggcaattgttattagttgttgttgttagtttnttagtaacgtaggtaacttcgtccgttacggtcggggaacccgtaaccgggg

SEQ ID NO: 438463 - DNA, 789 bp, Homo sapiens
  misc_feature: GZ8MTXP01DRHVX.44.36.D03.1.454.CMB.2.raw
  modified_base (279)..(279): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtcagagtgaagtgctaggttggtggaggtccgggggagtacgttggtccagccgtgggacgggtccctgagacttctcctgtgtcgctntggatcaccatcagtcgacctactatagtggacgtcgggtcccgccgaggcctaccggaagggggaagggggctggggagttcggcgttcgggaccgaaccaaaggttaaaaaaacaaggttcgaacccgaaagttacttttaagacaaacgagggtaaacgtacccggcccggtacgttacgtaggtaacggaaaacgtcccaaagttaacctttaccccgaaacccccgtttataaaccgaaaggaagtaacgttacgtaaacctttaaccgaaaaacggggttaaactttccttaaagtttacgtaaacttttccgaggtaaaccggtaaaatttacccgggaaacctttaaaacccggtaaacggaaaaaaccccgggaagggaaacccgaaagggggtaccttaaaggtttaacggttttaaattttagttttcgggttagtttttttaagtaggtttttaaaccttagtaccgttaagggttaaacccgtttgtaaaccccggg

SEQ ID NO: 438464 - DNA, 609 bp, Homo sapiens
  misc_feature: GZ8MTXP01BRGNC.44.36.D03.1.454.CMB.2.raw
  modified_base (217)..(217): a, c, t, g, unknown or other
  modified_base (303)..(303): a, c, t, g, unknown or other
  modified_base (367)..(367): a, c, t, g, unknown or other
  modified_base (445)..(445): a, c, t, g, unknown or other
  modified_base (496)..(496): a, c, t, g, unknown or other
  modified_base (510)..(510): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagccgtggagggtccctgagctctcctgtgtcgcctctggattcaccatcagtcgaccactatatggactgggtccncaggctccgagggagggctgggagtggcttgggccgagaagtaaaacagttcgccagtctttancaacagcgtacgccgcgtctggtagaaacgccagtacttccaccctctacaagagatcgtacttacgaaacgtaactntattaggatttccgtagacgtaaatcgaaacctaacgtaacgaaaaccggnggtaacgaccgggntaagttgttaatttagtttggttggtttagtttagttttattagttaacgaaggtaacgttcggtacccgacggttccgggggaaccgtaaaccggggg

SEQ ID NO: 438465 - DNA, 805 bp, Homo sapiens
  misc_feature: GZ8MTXP01CKCJI.44.36.D03.1.454.CMB.2.raw
  modified_base (774)..(774): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtgggacgggtccctgacgactctcctgtcgtcgcctctggatcaccatcagtcgacctactatagtggacgtcgggtcccgccgacgggtccgtacccgggaggggggtaacgggggtcgtagggggtaggttcgggtaccgtttcggggacccgtaaccgtaaaaaggttaaaaaaacgtaaacggtttcgaaccctaaaggttaccctttttaagaccaaacgtaacgggtacgtacccggcccgtcggtaccttaggtaacgaaaacggtcccgaagtaacctttaccccaaccccgtttactaaccgaaaggtagtaacgttaaccggtaacctttaaccgaaaaacggggtaacccctttaggttaactttaggtacctttaccgtacggaaccggttaaaactaccggtaaaacccgtttaaaaccccggaagggaaaaaacccccgggaaggggtaacccgaaaccggggtacttaaaggtttacggttaattttgtttggtttcgtttaagttacgttttaanacgtagttaacgttaaccgttcggtaacccg

SEQ ID NO: 438466 - DNA, 646 bp, Homo sapiens
  misc_feature: GZ8MTXP01BJJYE.44.36.D03.1.454.CMB.2.raw
  modified_base (317)..(317): a, c, t, g, unknown or other
  modified_base (415)..(415): a, c, t, g, unknown or other
  modified_base (587)..(587): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtggaggtccgggggagtacgttggtccagcctgggagggtccctgacgactctcctgtgtcgcctcgtggatcacatcagtgaccactatatggactcggggtccnccgaggcctccggaagggggaaggggctggggagttcgggcgttcgggaccgacgtaaaggtaaaaaacaaggtttcgaccctaaagtaccttttaanccaaacgaggacggtaccgccgtcgttctaggtacgaaaacgccaagtactttacccaaccccttgtacaaaggctattacgaactttacaaaggtaacttcgaatttcgaatttccgagaccgtaaatcggaaaccttaaaccgtaggaaaacccggaaggaacgacgggnttagttagtaatttagttggttgttaagttgtttaatatcggaagtaacttgtaacccg

SEQ ID NO: 438467 - DNA, 741 bp, Homo sapiens
  misc_feature: GZ8MTXP01BC3XG.44.36.D03.1.454.CMB.2.raw
  modified_base (333)..(333): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacattcttctacgaatagaacgaaaatcctaacagtacatctctagaagagctaagtttaaccatctaccaaggaccacctaccaaaggcaggtgtcttagtatagaccaanatacggaccctggcgacaccaggacacagtattaacgtgtgacgtaacgggtaagtgggaacgggaaagaaacgagtcgttgtttactagtaatttaataacgttacttacctagttcgtacgggtacgtcggtaggggtaccgaaaacggggggacccgtaaccgggttacccacccggttccgttaccctccgtacgtaccccgtttcccgaaacccggtaacccggggtccccctaacgggtttccccgggttccccgtttcccccccgggttacggggccccgtcccccggttcccggcccgtttccccggggaacggaacccgggtcccccgtaaacccgggtttccccgggggtacggggggttacccctaacccgggttaacccgggggtccccccggggg

SEQ ID NO: 438468 - DNA, 783 bp, Homo sapiens
  misc_feature: GZ8MTXP01ETANX.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacgccctggagtggcttgcacactatccttctacgaatagaaacgtaaaaactcctaacagtacatctctagaagagctaacgtttaaccatacctaccaaacggacctaaccctaccgaaaaaggccgtaaggggttacggttccttttaagtacgtacggaaccccaaacgtacgtcggacccctggaccggaccaccgaggacactaatacttaaaccgttgtcggacgtaaacggggtaaactcggggaaacggggaaaagaaaccgtagggtaccgtttggggtttttacctaggtttaatttaaacgttaaacggtttacctttaacctagttaccgtaacggggtacgtacgggttacgggggaaacccgaaacgggggggtaccccgtaaccggggttacctaacccccggttcctcccgtaccgtaccgtacccttacccgaaacccgaaccgggtcccctaacgttcccggttaccccttcccccggtggccccgtcccgtcgccccgttccggacggtaaccccgctaaccccgggttcgggcggggaccctaaccggccgggtcccccggg

SEQ ID NO: 438469 - DNA, 589 bp, Homo sapiens
  misc_feature: GZ8MTXP01B696P.44.36.D03.1.454.CMB.2.raw
  modified_base (308)..(308): a, c, t, g, unknown or other
  modified_base (321)..(321): a, c, t, g, unknown or other
  modified_base (360)..(360): a, c, t, g, unknown or other
  modified_base (394)..(394): a, c, t, g, unknown or other
  modified_base (480)..(480): a, c, t, g, unknown or other
tcagacagtatatacacgaccggtgctcgatttagctgcgtcacgatctctcttggggttcaactgtggtagagaagacaggattcaggacaatctccagcatggccggcttccctctcctcctcaccctcctcactcactgtgcagggtcctgggcccagtctgtgctgactcagccatcctcagcgtctgggaccccccggcagacggtcacgtattctttttgtctggaagtaggtcccaacatcggaaagttaattacgtatactggtatcggcaattcacaggagccggtccccagacccctnatctagtaggganaatcagccggccctcgacgggggtccctgaccgattccnctcgcctccagtctggccacctcagcccctcccnggccatcagtcgggctccggtcgaggagtgaggtctgtattactttcgtggtgggtcggtcgttgggatgacgtacgttccgtagngtggtacctgtcgttaagttcggggcggggtacgggaccgtaagcgttcggcccggttaccgtaacggtcaaccggcccgacggttccgtcccggttcccccgttccgg

SEQ ID NO: 438470 - DNA, 722 bp, Homo sapiens
  misc_feature: GZ8MTXP01EUMZR.44.36.D03.1.454.CMB.2.raw
  modified_base (494)..(494): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttatttacaggtgtcagagtgaagtgcgaggttggtggaggtcgggggatacgttggtccagccgtggacgggtccctgacgtactctccgtgtgtccgtcctgtggactcacatcagtcgaccatatagtggacgtcgggtccgcgaggccgtccggaagggggaacgggcgtgggaggttcggcgttcgggaccccgaagtaaaaggtaaaaaaaacgaaggttcgacccgtaaagtctttaagcaaacgaggtaacggtacccggcccgtcgtacgtagtaacgaaaacggcccaaggttaccttaccaaccccttntaacgaaaggagtatacgtaaccttaacgaaacgggtaacttactatttagtaactttcgaagaaccgtaaagtcgtaaaaccttaaacccgtaaacgggaaaaacccggaagggaaacccttaacgggggtacttaagttacgggttaattttaggtttgggtttagtttaaggtttaagttttaagtacgtaccggttaaaggtaacccgttttcggaaccccggg

SEQ ID NO: 438471 - DNA, 643 bp, Homo sapiens
  misc_feature: GZ8MTXP01BB9W9.44.36.D03.1.454.CMB.2.raw
  modified_base (329)..(329): a, c, t, g, unknown or other
  modified_base (398)..(398): a, c, t, g, unknown or other
  modified_base (456)..(456): a, c, t, g, unknown or other
  modified_base (464)..(464): a, c, t, g, unknown or other
  modified_base (493)..(493): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgctaggttgggtgggaggtccgggggagtacgttggtccaggcccgtgggtacgggtccctggacgtactctccgtgtcgtcgcctgtggatcaccatcagtcgaccatatagtggacgtgggtccnccaggcctccgagggggagggctgggagtggctggccacaaagtaaaaacagttcgccaagtctttaancagagtacgtaccgccgtacgttctagtacgaaacgtcccaagtacttccaacccctntacaaagngactacgtacttaacgaaaggtaaccttntaaatttgtaattccgtaggaactaaactcgtaaaccctaaaccggtaacgaaaaaccgggtcggaacgaccggggtacttagttaggttaatttagttgttacggtttgttagtttaactcgtagttaacggtaacgttcgtaacccgg

SEQ ID NO: 438472 - DNA, 701 bp, Homo sapiens
  misc_feature: GZ8MTXP01B31I8.44.36.D03.1.454.CMB.2.raw
  modified_base (672)..(672): a, c, t, g, unknown or other
  modified_base (692)..(692): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacgccgtggagtggcttgacacactatcttactacgaatacgaaacgtaaaactcctaacagtacatctacgtagaagagactaacgtttaaccactcctaccgaaacggaccaacctaacgaaaaggcgtaggttgttactttagtatcgaaccaacacgtacgacccgtagaccggacaccgacggacaactatacttaacgtgtgacgaagggttaacgacggaacgggaaaagaaacgtagtacgtttagtttacgtaggttaatttaagttaacgttaccttaaccgtagttaccggacgggttacgtacggttacgggggaaccgttaaacggggggacccgtacgggttacccaaccggttccctccgtaccgtaacggtcccttacccggaaacccgaacgggtccccctaaggtccccggttcccttccccgcggccctccctcgaccgttcgaacgggcccnccgtaacggcgggcggaccncggcggccg

SEQ ID NO: 438473 - DNA, 779 bp, Homo sapiens
  misc_feature: GZ8MTXP01BQT6O.44.36.D03.1.454.CMB.2.raw
tcagacagtatatacacgaccggtgctcgatttagctgcgtcacgatctctcttggggggagagcggagccccagccccagaattcccaggtgttttcatttggtgatcagcactgaacacagaggactcaccatggagttcgggctgagcttgggttttccttgttgttattttacaaggtgtccagagtgaagtgcagttgggtggaggtccgggggagcttggtccagccgtgggagggtccctgagactctcctgtcgtcgcctctggtactcacctatcagtcgaccactatagtggacgtcgggtcccgcgaggctaccggagggggaacgggggtcgtgggaggtcgggtcgttcggggacccgaagtaaacggtaaaaaaacgtaacggtttaccggaccctaaggttaccttttaataccgtaaaacgaacgggtaacggtaaccgggccccggtacggttccgttagggtaacggaaacgtacccgtaaggttaccttaccccaaccccgttcttaacccgaaaaggtacggaaatttacggaaccctttaacggaaaactaacctaccttaagtttaggggttaactttcgtacgtaacggttaaactacggtaaaccctaaaccgtaaacggaaaacccggtacgggaaaccaccggggataaggttagtttagtttagtttggtttagtttgtttagttttagttacttaagggtaactaacgtttcggacccgttacggtccgggggttaacccgtaaccggggg

SEQ ID NO: 438474 - DNA, 723 bp, Homo sapiens
  misc_feature: GZ8MTXP01ELSUG.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaacgaaaatcctaacagtacatctctagaagagactaagtttaaccatcctaccaaacggaccaccgtaccgaaaaggctaggttcggttactttaagtactacgaacccaaacgtactacggaccctggaccggacaaccgaggacactaattacttaaacgtgtcgacgtaaacggggtaaagtagggaaccgggaaaagtaaagttacggtacgtttaggtttacttaggttaatttaagttaaagttaccttaaccgtattacggtacggtaccgtcgggtaaggggaaccgtaaacggggggacccgtaccgggttacctaccgtaccgtccgtaccgtacgtacccttaccgaacccgtaaccggcccctacgtcccggttccccgttccccggtcggccccgtcccgtccgttccgttccggacggccgtaccgtaacccgttcggacgggggaccctaaccggaacggtccccggg

SEQ ID NO: 438475 - DNA, 879 bp, Homo sapiens
  misc_feature: GZ8MTXP01ED0ZI.44.36.D03.1.454.CMB.2.raw
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagtgcgtaggttggtggaggtccgggggatacgttggtccagccgtggagggtccctgagctctcctgtgtcgcctntggatcacatcagtgacctatatagtggacgtcgggtcccgccagggcctaccggaagggggtaacgggggtcgttagggggaggtttcgggcgtttacgggggacccgtaaccgtaaaacggttaaaaaaaacgtaaggtttcggacccctaaaaggttaccctttttaagacccgaacgtaaagggacggttacccggacccggtcgttaccgttaggtaagaaaacgcccgaagttaccttacccaaccccttctaaccgaaagagtaactacgtaacctttaacgaaaggggtaaacccttgtaaaccgttttggaaacttttacccgtaggtaaccgttaaaacgtttaccggtaaaaaccccgtttaaaaccggtaaaccgggaaaaaaccccggggaaaggggtaaaccccggttaaacccgggggtaaacttttaaacgggttttaaacgggttttaaacttttttaaacgggtttttcgggtttttaaacggggtttttaaggtttttaaagggttttttaaaattaaaccgggttaaccgggttaaaccggggtttaaaccgtttaaccccgggggttttaaacccccgggg

SEQ ID NO: 438476 - DNA, 671 bp, Homo sapiens
  misc_feature: GZ8MTXP01BDQUT.44.36.D03.1.454.CMB.2.raw
  modified_base (427)..(427): a, c, t, g, unknown or other
  modified_base (542)..(542): a, c, t, g, unknown or other
  modified_base (586)..(586): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtccagagtgaagtgcgtaggttggtgggaggtccgggggagtacgttggtccaggccgtgggacgggtccctgacgactctcccgtgtcgtcgcctcgtggactcaccatcagtcgaccatatagtggacgtcgggtcccgccgaggccgtcggagggggaacggggcgtaggggagtcggcgttcgggccgtaacgaaaaggtaaaaaacgtaagttcgacctaagttactttaancaacgaagtacgtaccgccgtcgttctagtagaaacgcctagtaccttccaccccttactaacgaagacgtaatcgtaacttaaccaaaggtaactcgtaattacggtacttcgngtaacgtaagttacgtaaaccttaaaccgaaacggaaaacccgnggaaccgacgggtacttagttagttatttagttggttagtttaagttagtttaactagtcgttaacggtaacgttggtaacccgg

SEQ ID NO: 438477 - DNA, 781 bp, Homo sapiens
  misc_feature: GZ8MTXP01EUB69.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaaatcctaacagtacatctctagaagagactaagtttaaccatcctaccgaaacggaccaacctaccaaaaggcgtagggttcggtactttaagtatacgaacccaacagtacggaccctggacggacaaccgtacggacaactaattaactttaaccgtaggtcggtaccggtaaacgggggttaaacgtacggggaaaccgggggaaaaaggaaaccgtagggttaccgtttagggttttacttaaggtttaaactttaagttaaacgtttacctttaaacccctattaccggttagggtacccggttacggtacgggggtaaccgtaaaacggggggggtaccccgtaaccggggttacctaaccccgggttcctaccccgtacgtaccgtacccttaccccgaaccgtaaccggggtcccctaacgtcccgggttccccttccccggtcggccccgtccccgttcgcccgttcccggaacgggccgtcccgtaacccggttcgggacgggggcctaaccggccgggtccccggg

SEQ ID NO: 438478 - DNA, 640 bp, Homo sapiens
  misc_feature: GZ8MTXP01EQO1R.44.36.D03.1.454.CMB.2.raw
  modified_base (297)..(297): a, c, t, g, unknown or other
  modified_base (313)..(313): a, c, t, g, unknown or other
  modified_base (380)..(380): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcaggtcggccccgaggggacgacggccagggacttaccgtggtgggggcgacggtccggttaggaaggtaaaagtgtacaggtggtaccagcagaagccaggccagacccctgngctggtcatctattangatgcggccgcctgagtgactccctgcgcgtcttcccgccggctacccaacgtcgtaacgggaaccnccgggaccctacccgtagacccagtccgaggccgaggggtcgacggggccggggatggaacgggccgaacgttagttaccgtgtaccaggtcgtgggtagggggactaggttaagtagtggaactcctaacgttcccggtggtacgttaccgggacgggacgggaaccaaaggttccgtacggttacccgtcgttacgggccgacggacccgtaacggccttaacccggcccccgtcggttacctccgttccgttccccg

SEQ ID NO: 438479 - DNA, 681 bp, Homo sapiens
  misc_feature: GZ8MTXP01BA8HY.44.36.D03.1.454.CMB.2.raw
  modified_base (446)..(446): a, c, t, g, unknown or other
  modified_base (507)..(507): a, c, t, g, unknown or other
  modified_base (655)..(655): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtgggaggtccgggggagtacgttgggtccagtccgtgggacgggtccctggacgacttctcctgtcgtccgcctctggactcaccatcagtcgacctactatagtcggactcggggtccgccgagggtccgtaccggaagggggaacggggggtctgggggagttcgggccgttcggggacccgaaacgtaaaaggttaaaaaaaccaaggttcgaccctaaagttcctttaancaacgaggtacgtacgccgtcgtctaggtagaaacgccgtaagtaccttcccaaccccttntaaccaaaggtagtatacgtaacttacaaacggtaactcgtaatttgtaattcgagacgtaaatacgtaaaccttaaaccgaaagaaaacccggaaggaaaccgacgggacttagtagttaattagttggttagtttgttagtttaanacttcgaacggtaacttcgtaaccgg

SEQ ID NO: 438480 - DNA, 594 bp, Homo sapiens
  misc_feature: GZ8MTXP01BSG1L.44.36.D03.1.454.CMB.2.raw
  modified_base (248)..(248): a, c, t, g, unknown or other
  modified_base (344)..(344): a, c, t, g, unknown or other
  modified_base (376)..(376): a, c, t, g, unknown or other
  modified_base (458)..(458): a, c, t, g, unknown or other
tcagacagtatatacacgaccggtgctcgatttagctgcgtcacgatctctcgttggggggggtcacaagaggcagcgctcttgggacgtctccaccatggcctgggctctgctgctcctcactctcctcactcaggacacagggtcctgggcccagtctgccctgactcagcctgcctccgtgtctggttctccgtggacagtcgatcaccatctcctgcacgtgggtccagcaatgacagttgganatactactgtctctgtatacaacaacatcaggaccaaaccgaccccaaactactattacttttagacgtcaggtacgagcgccgtacgtacggttnttactatccgtcttctcgtcgctaccacgtcncggaccacgtccgtcctccgtgtctactcgtcgtcgggcctacggcgtaggacggacgagtctacggtaacttagttaccgngtccgacttcttaacttacgtaacttcgttagtcgtacggtttgggtacggttcgggacgggttcgggtacctcgttacccggcgttacccggtcgtacgggtccaccggtacccgacgtcccgttccggtccccg

SEQ ID NO: 438481 - DNA, 706 bp, Homo sapiens
  misc_feature: GZ8MTXP01E0P5G.44.36.D03.1.454.CMB.2.raw
  modified_base (279)..(279): a, c, t, g, unknown or other
  modified_base (410)..(410): a, c, t, g, unknown or other
  modified_base (459)..(459): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggaggtccgggggagtacgttggtccaggccgtgggacgggtccctgagactctcctgtgtcgcctntggatcacatcagtcgaccatatatggactcgggtcccgccgaggcctaccggagggggaacgggggtctagggaggtcggcgttgggaccgacaaaggtaaaaaacaaggttcgacctaaagtctttaancaacaggacgtaccgccgcgtctgtagaaagccagtacttccacccctntaccgaaagagactacgaactttacaaacgggtaccttataatttacggtaactttcgacgtaacggtaaaacgtttacggaaaccctttaaaaccggaaccggaaaaaacccgggtaagggaaacccgttaacgggggaaccttaaggttaaggttttaagtttagttttgggtttaggtttttaagggtttagtttttaacctaagttacggttaaacgggtaaaccgtttcggtaacccccggg

SEQ ID NO: 438482 - DNA, 762 bp, Homo sapiens
  misc_feature: GZ8MTXP01CBEHC.44.36.D03.1.454.CMB.2.raw
  modified_base (457)..(457): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgtttgttattttacaaggtgtccagagtgaagtgctagttggtgggaggtccgggggagtacgttggtccaggcccgtggggacgggtcccctggacgtaccttccttcctggtcgtccgcccttcgtggtacttccaccattcagtcgacccacttatagtcggacgtcgggtcccgccgaggtccgtaccggagggggaaggggtcgtgggaggtggacgttcgggacccgtaacgtaaaaggttaaaaaacgaaggtttcgacccgtaagttaccttttaanacccgaacgaaggtacgtaccggccgtcgtcgtagtaacgaaacggccctaagtaccttacccgaccccttactaacgaaacgagtacgttagtaacccttacgaaacgtacttaacctagtttacgactttaccgtaggtaaccgtaaagtaacggtaaacccttaaaacccgtaacgggaaaaaacccgggcgggtaaacggaacccggggtattagtttaaggttattttaaggtttggtttagtttaaggtttacttttaagttagttaccgggaagtttaacccgttcggttaaccccgg

SEQ ID NO: 438483 - DNA, 633 bp, Homo sapiens
  misc_feature: GZ8MTXP01ARKDM.44.36.D03.1.454.CMB.2.raw
  modified_base (408)..(408): a, c, t, g, unknown or other
  modified_base (474)..(474): a, c, t, g, unknown or other
  modified_base (560)..(560): a, c, t, g, unknown or other
  modified_base (572)..(572): a, c, t, g, unknown or other
  modified_base (599)..(599): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccagccgtgggacgggtccctgagactctcctgtgtcgcctctggatcaccatcagtcgaccactatagtggacgtcggggtcccgccgagggcctccggagggggaagggggctggggagtgggcgttgggccgaccgaaagtaaaaacaaggttcgacccaagtcttttaanccaacgagtaacgtaccgcccgcgttctaggtacgaaaacgcccaaggtactttcccaaccccttntaccgaagacgatcgaactttacaaaggtaacttctaattgactttcgagaccgtaaatcgaaaccttaaaccgtaggaaaaccgnggacaaccgggnagttaggttattagtttggttagtttnttgtttaatctcggaacggtaacttggtaacccg

SEQ ID NO: 438484 - DNA, 907 bp, Homo sapiens
  misc_feature: GZ8MTXP01DHC5H.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgctagttggtggaggtccgggggagtacgttggtccacgccgtgggacgggtccctggacgtactctcctgtcgtcgctctggactcacatcagtcgaccactatagtcggacgtcgggtcccgccgaggccgtaccggagggggaacgggggtctgggggacggttcgggtccgttggggaccccgtaacgtaaaacggtaaaaaaaacgtaaggtttccgacccgtaaacggttacctttttaacgacccgtaaaccgaaacgggtaaacggttaaccccgggtccccgggtacgggttacccgttaagggttaacgggaaaaaacggtccccgtaagggttaacctttaccccgaaaccccctttacgttaaccgaaaagggacgttaaacgtaccggtaaaaccttttaccgaaaaacggggttaaaccctttcttaaaccgttttaggtaaccttttacgtacggtaacccgttaaaaagttcccggtaaaacccttaaaaccccggttaaaccgggaaaaaaaccccgggtaaaccggggaaacccggttaaacccgggggtaacttaaaggtttaacggtttaaagttttaaacggtttttgggtttaacggttttttggtttaaacgggttttttaaacttaaagttcccggaaaaagggttttaacccgttaacccggggtttaaccccccggggg

SEQ ID NO: 438485 - DNA, 694 bp, Homo sapiens
  misc_feature: GZ8MTXP01EV0Q6.44.36.D03.1.454.CMB.2.raw
  modified_base (284)..(284): a, c, t, g, unknown or other
  modified_base (410)..(410): a, c, t, g, unknown or other
  modified_base (484)..(484): a, c, t, g, unknown or other
  modified_base (598)..(598): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgctaggttggtgggaggtccgggggagtaccgtttggtccaggtccgtgggacgggtccctgagactctcctgtgtcgcctntggatcaccatcagtcgaccactatagtggacgtcgggtccgccgaggctccgagggggaaggggcctgggagtggcttcgggccgacaaaggtaaaaaacaagttcgaccctaaagtcttttaanccaaacgaggtaacgttaccggccggtcgttcgttaggtagaaaacgcccaaggtactttacccaacccccttntaaccgaaagtagtactacggtaaaccttacgaaacgggtaaacttctaatttacgaagtttctacggaaccgtaaatcggtaaaccttaaacccggtaacggaaaaaacccgngggaaacccttagggggaccttaagttagttaatttagtttggttcgtttgttaggttttaacctgtacgttaacgggtaacgtttcggtaacccg

SEQ ID NO: 438486 - DNA, 701 bp, Homo sapiens
  misc_feature: GZ8MTXP01DEWK5.44.36.D03.1.454.CMB.2.raw
  modified_base (389)..(389): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccgaggggacgacggcaggattaccgtggtggggcgacgcgttggaggtaaagtgtacagtggacagcagaagccaggccagacccctgtgctggtcatctaattatgagtggccgggcccggccctcgagttcgacttccccgtgccgcgtcctttccccgcccggctcccaaaccgtccgtaacgggggaaacccnccgggccctaaccccgtcgaaccccatcgaacggccggacggggtcggacggggccgggggagtacggacgggaccgtaacgttaacgttaccgtgtacgaggtcgtagggtaggggggtaacgtagggttaaggttaggttagaacgtcgtaacggttccccgggtgggtttacggttaccgggggccggggaacggggaacccgtaacggccggttacggacccgggttccggtcggggttaccgccggaccccggtaacggtcccgtcccggtcccccgtccgggttcctaaccgttccgtttccccgg

SEQ ID NO: 438487 - DNA, 772 bp, Homo sapiens
  misc_feature: GZ8MTXP01EBLLF.44.36.D03.1.454.CMB.2.raw
  modified_base (324)..(324): a, c, t, g, unknown or other
  modified_base (685)..(685): a, c, t, g, unknown or other
  modified_base (726)..(726): a, c, t, g, unknown or other
tcagacagtatatacacgaccggtgctcgatttagctgcgtcacgatctcttttggggagctctgagagcggagccccagccccagaattcccaggtgttttcatttggtgatcagcactgaacacagagactcaccatggagttcggctgagtcgttgggttttccttgttgtttattttacaaggtgtccagagtgaagtgcgtaggttggtggaggtccgggggagtacgttggtccaggtccgtgggacggtccctgacgtactctccgtgtcgtcgctctgactcacatcagtcacactatagtggacgtcgggtcccncgaggccgtaccggagggggaacggggtccgtgggtacggttggtccgttacggggacccgtaacgtaaaaacggtaaaaaaccgtaaaggtttccgacccgtaaaggtttaaccctttaacgtcccgaaacggtaaacgggtaacccggttaaccccgggtccccggttaccgggttacgttacgggtaaaccgaaaaccgtccccggtaaagttaccctttaccccgaaacccccgtttactaacgaaagtaacggaacttaccgtaaacctttaacgaaacgttaacctcgttaaagtttacgtactttcgacgaacgttaaatacggtaaacccttaaaccgaacggaaaacccggnggtaaccgacggttattagtttagttaatttagttggtttntttacgtttaagttataacgtcgtagttaccgtcgttcgtaacggg

SEQ ID NO: 438488 - DNA, 600 bp, Homo sapiens
  misc_feature: GZ8MTXP01AJW1T.44.36.D03.1.454.CMB.2.raw
  modified_base (390)..(390): a, c, t, g, unknown or other
  modified_base (409)..(409): a, c, t, g, unknown or other
  modified_base (438)..(438): a, c, t, g, unknown or other
  modified_base (519)..(519): a, c, t, g, unknown or other
  modified_base (567)..(567): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccgggggagacgttggtccagcctgggagggtccctgagactctcctgtcgtcgcctctggatcaccatcagtgaccactatagtggactgggtcccgccaggctaccgagggggagggctgggagtggcttcgggccgacaaaggtaaaaacaagttgaccctaagtctttaancaacgagacgtaccgccgngtctgtagaaacgccagtcttccaccctntacgaagagatcgacttacgaaaggtaactctattgacttcgtgacgtaaatcgtaaacctaaaccgtaggaaaaacccgnggaaccgacggggcttaaagttgttaatttagttgttcggttaagttntttaactatcggaagggttaacttggtaacccg

SEQ ID NO: 438489 - DNA, 698 bp, Homo sapiens
  misc_feature: GZ8MTXP01B5AP6.44.36.D03.1.454.CMB.2.raw
  modified_base (322)..(322): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtcagagtgaagtgcaggttggtgggaggtccgggggatacgttggtccaggtccgtgggacgggtccctgagtactctcctgtgtcgctgtgatcacatcagtcgaccactatagtcggacgtcgggtcccncgaggcctaccgggaagggggaacgggggtctaggggacggttcgggcgttcgggaccgtaaccgaaaaggttaaaaaaacgaggtttcgaccctaagttacctttaagccaaacgtaggacgtaccgccggtacgtcgtagtacgaaacgccaagtacttacccaccctactacgaagacgatacgtaacttaccgaaaggtacttacgtattacgtaattccgtaggaacctaaagtacggtaaaccttaaacccgtaaacggaaaacccggaacggtaaaccgacggggtaccttaaggttactttaaggtttattttaggttcgttttaagttcgtttaatagtacgttaacggtaaccgttcgtaacccgg

SEQ ID NO: 438490 - DNA, 720 bp, Homo sapiens
  misc_feature: GZ8MTXP01AXUE4.44.36.D03.1.454.CMB.2.raw
  modified_base (312)..(312): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacaggctctgtgacctcctatgtgctgactcacgcccaccctcagtgtcagtcggacccaaggaaagcgccaggtacttacgtggtaggggaaacatagttaggaagtaaagtgtagacacgtcggtacagacaagacgccgaggccacggcccctgtgcgtggtcatctattangatacgccggacccggccctaggacgggtacttcccgtaggacgtccgtactttcgtcgtcggtaccctaacccgtaacgtcggtaacgggaaacccacccgggacccctacccgtcgaaccctacgtaccgacgggtacggaaggggaccgggaagggtcccgggggtaagtcggggaaccgggtccgtaaaccgtttagttaaccgttagggtacggttaggggggtcgggtaaggggttaacgttaagggttaggttaacggtgtagttaccggagggttcgggggttacggttccgggggacgggaacggtaccgaggtccgttaccggaccgggttcttacgggttccgaccgcccggtacgcccggttcccgaccccgttcggtcccttcggtttaaccccg

SEQ ID NO: 438491 - DNA, 748 bp, Homo sapiens
  misc_feature: GZ8MTXP01DT9OP.44.36.D03.1.454.CMB.2.raw
  modified_base (518)..(518): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcgtagttgggtggaggtccgggggagtacgttggtccaggtccgtgggacgggttccctggacgtactctcccgtgtcgtcgcctctggactcacctatcgaagtcgacctactatagtcggacgtcgggtccgccgaggccttaccggaagggggaacgggggtctagggggagtcggtacgttgggcccgaacgaaaggttaaaaaaaccaggtttccgaccctaaacggttacttttaagacaacgagggtaacgtaccgccggtacgttcctgttagaaacgtccgagtacttacccaacctcgtagaaacgnaacgttcgaacttaccgaaaggtacccttactaaagtttctaacgtttcccgtaggaacccgtaaaagtaccgtaaaaccgtttaaacccgaaaccggaaaaaacccgggtggaaaccccggaggggtaaccttaaggttaacgtttaagttttaaggtttcggtttaggttttaagttaggtttaattacgtaccgttaaagggggttaacccttcggttaaccccggg

SEQ ID NO: 438492 - DNA, 556 bp, Homo sapiens
  misc_feature: GZ8MTXP01ER9F9.44.36.D03.1.454.CMB.2.raw
  modified_base (224)..(224): a, c, t, g, unknown or other
  modified_base (285)..(285): a, c, t, g, unknown or other
  modified_base (292)..(292): a, c, t, g, unknown or other
  modified_base (335)..(335): a, c, t, g, unknown or other
  modified_base (343)..(343): a, c, t, g, unknown or other
  modified_base (451)..(451): a, c, t, g, unknown or other
  modified_base (470)..(470): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccggggganacgttggtccagcctggagggtccctgagactctcctgtcgtccgcccctggacttcaccntcagtcnacgtactatagtagtacgtcggtcgccgcgcgacgacggaggnaccgtggngtggcgtcgacgtaacgaagtaaacgaaacgtagcgtagactactacacgacgacgacgtccgcgtcgtagtcgaagactacgactactaccacgtacgacagactanacgtactacgaactacatntagtcgtagtcgaacgttaactacgaaaccgtaacgaacgaacggacgacggtaacgtagtaagttagttagttagttgtttgttg

SEQ ID NO: 438493 - DNA, 749 bp, Homo sapiens
  misc_feature: GZ8MTXP01CWG8L.44.36.D03.1.454.CMB.2.raw
  modified_base (279)..(279): a, c, t, g, unknown or other
  modified_base (287)..(287): a, c, t, g, unknown or other
  modified_base (418)..(418): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttgggtgggaggtccgggggagtacgttggtccaggccgtgggacgggtccctgacgactctcctgtgtcgctntgatcacntcagtcgaccactatagtggactcgggtccgccgaggcctaccggagggggaagggggcgtagggaggtggcgttcgggaccgaacgtaaaggtaaaaaacgtaaggtcgaccctaaagttaccttttaanaccaaacgacggtacggtaccgccgtcgttacgtagtacgaaacgccctaagtacttacccaccccttataccgaaagacgtacttacggtaaccttaacgaaacggggttaaccttacgtaagttttacgtaacgttttccgtaacggtaaccgtaaacgtaccggtaaaaccccttaaaacccggtaaaaccgggaaaaaacccccggggaaggggtaaccccggaaacggggtccttaaaggttttacgttaattttaggtttggttaggttttaacggtttattttaagtacgttacggaacggttaacccgttggtaacccccggg

SEQ ID NO: 438494 - DNA, 712 bp, Homo sapiens
  misc_feature: GZ8MTXP01DX1FX.44.36.D03.1.454.CMB.2.raw
  modified_base (221)..(221): a, c, t, g, unknown or other
  modified_base (269)..(269): a, c, t, g, unknown or other
  modified_base (312)..(312): a, c, t, g, unknown or other
  modified_base (394)..(394): a, c, t, g, unknown or other
  modified_base (492)..(492): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgctaggttggtggaggtccggggganacttggtccagccgtggacgggtccctgagactctcctgtgtcgcctntggattcaccatcagtcgacctatatagtggacctgggtcccnccgaggcctaccgagggggaagggtctgggagtggtcgttgggcccgacaaagtaaaaacaagttcgaccctaggtctttanccaaacgagtaacggtaccgcccgacgttctggtacggaaacgtcccaggtactttcccacccttctacgaaaggtaacgtagtacgtaaccctttanaaaaacggtacttacctaagtttgggtaactttccgtagtacccgtaaagtccgtaaaacccgttaaaccgaaacggaaaaacccgggtggaacccgtaacggggctaaagttcgtttaagtttaatttggttaggttttacgttaggttttaattacgtcggtaaacggtaaccttgggtaccccgttacgggttaacgggggccccgtaaaccggggg

SEQ ID NO: 438495 - DNA, 714 bp, Homo sapiens
  misc_feature: GZ8MTXP01AEFOT.44.36.D03.1.454.CMB.2.raw
  modified_base (587)..(587): a, c, t, g, unknown or other
  modified_base (630)..(630): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcagttggtggaggtccgggggagacgttggtccagccgtggacgggtccctgagactctccgtgtcgtcgcctgtgtactccacatcagtcgaccatatagtcggacgtcgggccgaccgaggccgtacggagggggaacgggcgtagggaggtcggtcgttcgggacccgtaacgaaaacggtaaaaaacgtaaggttcgacccgtaaacgttaccttttaacgaccgaaacgaagggtaacggttacccgcccggtacgttacgtaggtaacggaaaaccgtccccaaaggttacctttaccccgaacccccttgtaacgaaagggtaactagtacgtaacctttaacgaaacgggttactacgttagttacgtaactttccgngaacgtaaacttcggaaaccttaaacccgaaggaaaacccggngaaccgacgggtattaagtttgttaatttggttgttagtttaaggtatttaatacgtacgttaaagggtccttcggtaacccgg

SEQ ID NO: 438496 - DNA, 771 bp, Homo sapiens
  misc_feature: GZ8MTXP01A9H1X.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggacggccctggagtggcttgcacacattcttctacgaatagaaacgaaaatcctaacagtacatctcgtagaagagactaagtttaaccactcctaccaaacggaccaaccgtaaccgaaaaggcgtaggttcggttactttagtactacgaacccaaacgtacgtacggacccgtcggacggaaccacccgacggacaactaacgttaacttaaacgtggtaacggaccggtaaacggggtaacgtacggggaaacggggaaaacgaaacgagttaccgtttagggttttaaccttagtttaaatttaagttaacgtttacctttaaaccaagtttccggtagggaccgggttacggtacgggggtaaccgaaaacggggggtaccccgtaaccggggttacctaaccccggttccttaccccgtacggtaaccttacccgttaccccgaaacccgggtaacccggggtcccctaacgttccccgggtcccctttccccggcgggcccctcccgtcggaccttccggacgtccgcctaacccgtcgggacgggacctaacggcggtcccggg

SEQ ID NO: 438497 - DNA, 727 bp, Homo sapiens
  misc_feature: GZ8MTXP01BX5A8.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaacgaaaatcctaacagtactatctcgtagaagacgtactaacgttaaccactacctaccgaacgaccaaccctaaccgaaacggtcgtaggttacggtttactttagtactacgaacctaacgtacgtaccggacccgtcggaccggacgaccgacggacaactattacgttaacgtcgtcggacggtaacgggtaacgtagggaacgggaaacgaacgtacgttacgtttagtttacgttagttaatttaacgttaacgttacccttaacgtacgttacggtacggtaccggtacggtacggggaaccgtaaacgggggtacccgtaccggtaccctacccgtcctcccgtcgtacgtccctacccgaccggtaccggtccctcggttccccgttcccgttccccggtcggcccgtccccgtcgttcccgttccgacggtccgtcccgtaaccggtcgggtcgggaccgtaaccggcggtcccggg

SEQ ID NO: 438498 - DNA, 611 bp, Homo sapiens
  misc_feature: GZ8MTXP01AF1QI.44.36.D03.1.454.CMB.2.raw
  modified_base (405)..(405): a, c, t, g, unknown or other
  modified_base (408)..(408): a, c, t, g, unknown or other
  modified_base (418)..(418): a, c, t, g, unknown or other
  modified_base (449)..(449): a, c, t, g, unknown or other
  modified_base (540)..(540): a, c, t, g, unknown or other
  modified_base (585)..(585): a, c, t, g, unknown or other
  modified_base (592)..(592): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttccttgttgttatttacaaggtgtccagagtgaagtgcagttggtgggaggtccgggggagtacgttggtccaggccgtgggacgggtccctggacgactctcctgtcgtcgcctctggactcaccatcagtcgaccactatagtggacgtcgggtccgccgaggctaccggagggggaagggcgtggggacgtggcttcgggccgacaaacggtaaaaacaagttcgactaagtctttaancanagcgtacgcncgtctgtagaaacgcagtacttcccaccctntacaaagacgtatacgaactttacgaaacgttactctattaggtatttcgacgagtaaactcgtaaacctaaacccgaaggaaaacccggnggaacgacggggtacagttacgtatttagttggttctttaaggtnttaattncgaggtaacttgtaaccgg

SEQ ID NO: 438499 - DNA, 821 bp, Homo sapiens
  misc_feature: GZ8MTXP01AQ3L9.44.36.D03.1.454.CMB.2.raw
  modified_base (429)..(429): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggaggtccgggggagtacgttggtccaggccgtgggacgggtccctgagactctcctgtgtcgctgtgatcacatcagtgaccatatagtggacgtcgggtccgccgaggctccggagggggaacgggggcgtaggggaggttcgggtcgtttcggggcccgtaccgaaaacgggttaaaaaaactaaggtttcgaccccgtaaaggtacctttttaanacccgaaacacgggtaacgtaccgggcccgtacggttctagtaagaaacgtccaagtacttacccaacccctactaccaaaggacgtaagttacggaacctttaacgaaacggtaaaccgttacctaagtttaggtaacttttcggacgtaaccggtaaacgttaaccggtaaacccgttaaaaccccggttaaacggggaaaaaaccccgggtaacggggtaaacccggaacccggggggtaaaccttaaacggtttaacgggttttaaactttttaaacgggtttttgggtttacgggtttttaagggttttaaacggtttttttaaacggtaaagtttaacccgggttaacggggtttaaaccccgttccgggttttaaacccccgggg

SEQ ID NO: 438500 - DNA, 816 bp, Homo sapiens
  misc_feature: GZ8MTXP01BEL36.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgttggtccagcccgtggagggtccctgagactctcctgtgtcgcctgtggtatcacctatcagtcgaccactatagtcggacgtcgggtcccgcaacgggtcctacccggaaggggggaaagggggtccgttagggggaacggtttcggggaccgtttcgggggaccggtaaccccgtaaaaagggttaaaaaaaaaccgtaaagggttttccggacccgtaaaacgggttccctttttaagaccctaaacgaaagggtaccggttaacccgcccgggtcgttacctggttaaacgaaacgggtcccaaggtaacctttacccgaaacccccgttctaacgaaagggaacgtaacttaccggtaaactttaacccgaaaggggtaaacccttccgtaaatttaggtaacttttcccgaggtaaccgtaaagttacggtaaaccctaaacccgtaacggaaaaacccgggaaggtaaaccgaccgggggtaacttaacggttacggtttaatttagtttccgggttaggttttaaggttcgttttaaagtacggttaccgttaagggttaaaccgtttcggttaaccccg

SEQ ID NO: 438501 - DNA, 804 bp, Homo sapiens
  misc_feature: GZ8MTXP01AWYW6.44.36.D03.1.454.CMB.2.raw
  modified_base (432)..(432): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttatttacaaggtgtccagagtgaagtgcgagttggtggaggtccgggggagtacgttggtccaggcccgtgggacgggtccctgacgtacttcttcgtgtgtcgctctggtatcacatcagtcgacctatatagtggacgtcgggtccgccgacggccgtaccggagggggaacggggtcggtgggacggttcgggcgttcgggaccgtaccgtaaaggtaaaaaaacgagtttacgaccctaaaggttactttaanaccgaacgaaggtaccgtaccggccggtacgttcgtaggtacgaaacggccaagtacttaccgaaccctcgtaacgaaagagtaacttacggtaaccttacgaaacggtaaccttacgttaagtttacggtactttaccggtagttaaccgggtaaaacttcgggtaaaacccctttaaaccccggtaaaaccgggaaaaaacccggggtaaccgggaaaccgggttaaacccgggggtaaaccttaaagtttaacgggtttaaagtttttaacggttttcgggttttaacgggttttaaggttttaagggtttttaacttaacggttacccggttaaaaggggtttaaccgttccggtttaacccccgggg

SEQ ID NO: 438502 - DNA, 791 bp, Homo sapiens
  misc_feature: GZ8MTXP01AYJTD.44.36.D03.1.454.CMB.2.raw
  modified_base (344)..(344): a, c, t, g, unknown or other
  modified_base (378)..(378): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgctctggattcaccatcagtgaccactatagtggactgggtccgccaggctccgaggggaggggctgggagtgggcttgggccganaaaggtaaaaacaaggttcgacctagtcctttancaaacaggaacggtaccgcccggtacgttctaggtagaaaacgcccaaggtactttacccaaccccttctaacgaaaggtacgtaacttacgggtaacctttaacgaaaacgttaaacttactaacgttttagggggtaacttttaccgttacggaacccgggttaaaaatttcggtaaaaaccccgtttaaaacccgtttaaaacggggaaaaaaaaccccgggtaggggtaaaaccccggaaccggggggtaaccttaaacgtttagggttttaaagtttttaaacggttttgggttttaaggttttaagggttttaggtttttaaaccttaggttaacccgtaaggggttaaacctttcgggtaccccgttaacggggtcccgggggttaacccggttaaaccccggggg

SEQ ID NO: 438503 - DNA, 688 bp, Homo sapiens
  misc_feature: GZ8MTXP01CJTBJ.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtgggaggtccgggggatacgttggtccagccgtggagggtccctgagctctcctgtgtcgcctcgtggactcacatcagtgaccatatagtggactcgggtcccgccgaggcctccggagggggaacgggggctgggagtggacgttcgggacccgacgtaaaggtaaaaaaacaaggtttcgaccctaaagtacctttttaagcctaaaccgaggtacggtacccgcccggtacgtccttaggtagaaaaccgccgaagtaccttacccaaccccgttacgtaccaaaggagtaacttacggaacctttacgaaaaggggtaacttacgtaatttcggtattccgtagaccgtaaatcggtaaactaaaccgtacggaaaacccggaaggaaccacggggtacaagttagttaagtttagttggttagtttaaggttagttttaacagttaccgaaggtaacccgttggttaaccccg

SEQ ID NO: 438504 - DNA, 543 bp, Homo sapiens
  misc_feature: GZ8MTXP01EJ1XV.44.36.D03.1.454.CMB.2.raw
  modified_base (317)..(317): a, c, t, g, unknown or other
  modified_base (367)..(367): a, c, t, g, unknown or other
  modified_base (405)..(405): a, c, t, g, unknown or other
  modified_base (419)..(419): a, c, t, g, unknown or other
  modified_base (428)..(428): a, c, t, g, unknown or other
  modified_base (468)..(468): a, c, t, g, unknown or other
  modified_base (497)..(497): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattaccgtggtgggggcgacgccggttggaaggtaaaagtgtacagtggtaccagcagaagccaggccagacccctgtgctggtcatctattatgatgcggccgcctnagtgatccctgcgcgcttccctccggctaccgaaatccgtagggaacccncggcccaccctgaccatcagcagggtcgaggccggggntggagccgatatcngtcagctgngggggacagtagtagtgatcagtccgtggtatcgggcggngggaaccaagctaggccgcgtggggttcngttccccaagggtcctcgcccccgttcggactccgttcgttccccg

SEQ ID NO: 438505 - DNA, 822 bp, Homo sapiens
  misc_feature: GZ8MTXP01CDZ9E.44.36.D03.1.454.CMB.2.raw
  modified_base (285)..(285): a, c, t, g, unknown or other
  modified_base (289)..(289): a, c, t, g, unknown or other
  modified_base (441)..(441): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgtttattttacaaggtgtccagagtgaagtgcgtaggttgggtgggaggtccgggggagtacgttggtccaggccgtgggacgggtccctgagtactctcctgtgtcgctntgtntcacatcagcacctactatagtggtacgtcgggtcccgccgaggccgtaccggagggggtaagggggtctgggggaggtcggtcggttcgggaccgtaaccgtaaaacggtaaaaaactaacggttcgacccgtaaaaggttaccttttaanaccgtaaacggtacggtaaccgggtacccgggcccggttccgggtacgttacggttaaacggaaaaccgggtcccctaaacgggttaccctttacccccgtaaaccccttttacccgtaaaccggtaaacggaacgggttacttaaaccgggttaaaccgttttaaaccgaaacggttaaacctttaccgttaagtttacgttaaactttccgtaacggtaaccgtaaagttaccgtaaaccgttaaaacccgtaacggaaaaccgggaacggtaaacccggacggggtacttaaggttgtttaattttaaggtttggtttgttttaagttacgttttaagttacgtacggttaacgttaaccgttcggttaaccccgggg

SEQ ID NO: 438506 - DNA, 959 bp, Homo sapiens
  misc_feature: GZ8MTXP01BIK51.44.36.D03.1.454.CMB.2.raw
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccgagccgtgggacgggtccctgagactctcctgtgtcgctntggatcacatcagtcgaccatatagtggacgtcgggtcccgcagggcctacccggaagggggaacgggggtcgtgggggtaggttcgggtaccgtttcggggaccccgtaacgtaaaacggttaaaaaaaaccgtaaagggttttccggaaccccgtaaaagggttacccttttttaaagacccgaaaccgggtaaacgggtaacggtttaacccccgggacccccgggttcggtttacccgttagggttaaacggaaaaacccgggtacccaaacgggttaaccctttaccccgaaaacccccccgttttacttaaaccccgaaaaagggtaccggttaaacgttaccggtaaaacccctttttaacgaaaaacggggttaaaccctttaaccgtttaagttttacgggtaaaacctttttccgtaacggggttaacccgtaaaaaggttttacccggtaaaaaccccttttaaaaaccccgggtaaacggggtaaaaaaaacccccggggtaaggggaaaccccgggttacgggggtaacccttaaacgggtttaagttttaaacggtttttaagtttttcggggttttagggtttttaaggtttttaaggtttttaagggtttaaactccggggtttaaaaccgggtaaacccgtttttccggggttaaacccccgggg

SEQ ID NO: 438507 - DNA, 743 bp, Homo sapiens
  misc_feature: GZ8MTXP01DW658.44.36.D03.1.454.CMB.2.raw
  modified_base (211)..(211): a, c, t, g, unknown or other
  modified_base (496)..(496): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcagttggnggaggtccggggatacgttggtccagccgtggaggtcctgagactctcctgtgtcgctctggatcacatcagtcgaccactatagtcggacgtcgggtccgcgaggcctaccggagggggaagggcgtagggagtcgggcgttacgggaccgtaaccaaaggtaaaaaaacaaggtttcgacccgtaaaacggttacttttaacgacaaacgaaggtaacgtaccggcccgtacggttcctaggtaacggaaacgtcccaaggtaccttaccgaaaccccctttnaacgaaagaagtacgtacgtaaccttaacgaaacgtaacttactaagtttacgtacttacgacgtaacgtaaacgtaccgtaaaacccgtaaaccggtaaaccggaaaaccggtaacgggaaaccgttacggggtacttaaagtttaaggttttaacgttttaggttttcggtttagggttttaagtttaagttttaacgttacggttacggttaaacggggtttaaccgttccgggttaaccccgg

SEQ ID NO: 438508 - DNA, 625 bp, Homo sapiens
  misc_feature: GZ8MTXP01BYH3A.44.36.D03.1.454.CMB.2.raw
  modified_base (286)..(286): a, c, t, g, unknown or other
  modified_base (406)..(406): a, c, t, g, unknown or other
  modified_base (493)..(493): a, c, t, g, unknown or other
  modified_base (545)..(545): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccagccgtgggagggtccctgagactctcctgtgtcgctctggatcaccntcagtgaccactatatggacgtcggggtcccgccgaggccgtccggagggggaacgggggctggggaggtgggcgttggcccgacaaaggtaaaaacaagttcgacccaagtcttttaancaacgagtacgtaccgccgcgtcgtgtagaaacgccagtacttccaaccccttctacaagagatacgacttacaaacgggtaacttntattgtattcgtgacgtaaatcgtaaaccttaaaccgtacggaaaacccggnggaaccgccggggattagttgttatttagtttggttgtttcgttagtttaattactagacggtaacttcggttaaccccg

SEQ ID NO: 438509 - DNA, 537 bp, Homo sapiens
  misc_feature: GZ8MTXP01A1M3C.44.36.D03.1.454.CMB.2.raw
  modified_base (275)..(275): a, c, t, g, unknown or other
  modified_base (296)..(296): a, c, t, g, unknown or other
  modified_base (312)..(312): a, c, t, g, unknown or other
  modified_base (450)..(450): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgcttgggttttccttgttgctattttagaaggtgtccactgtgaggtgcggctggtggagtcgtgggggaggcttggtacgagggcggggggggtccctggagactctcctgtcgcagcctcnggattcatcttcagtgactangccatgaactggtccncaggctccgagggagggctggagtggttcatatgtaatattgctggagactaccacctactacgcagactcgtgtacggagggccattaccaactaatcccgaagggacaatcgaccaaaggactacactagtacgtntaggaaatagacgacacgtgaggaaggagaaggggcaacgggtcacgttcttacttcgtgttcgaagtagagcgggtcaacgtttgg

SEQ ID NO: 438510 - DNA, 589 bp, Homo sapiens
  misc_feature: GZ8MTXP01A4D88.44.36.D03.1.454.CMB.2.raw
  modified_base (379)..(379): a, c, t, g, unknown or other
  modified_base (474)..(474): a, c, t, g, unknown or other
  modified_base (514)..(514): a, c, t, g, unknown or other
  modified_base (528)..(528): a, c, t, g, unknown or other
  modified_base (536)..(536): a, c, t, g, unknown or other
  modified_base (559)..(559): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccctgggagggtccctgagactctcctgtgtcgcctctggatcaccatcagtgaccactatatggactgggtccgcaggctccgaggggagggctgggagtggcttggccgacgaagtaaaaacaagttgacccaagtctttaancacagacgtacgccgacgtctagtagaaaacgtcccagtacttccaaccctctacaagagtatgactttacaaaggtactcatttagactttcgngaccgtaaatcggaaaccctaaacctaggaaaaaccccgnggaacaaccggggnttaagttntaatttaagttggttagtttgtntttaatatccgaggtaacttggtaaccccg

SEQ ID NO: 438511 - DNA, 761 bp, Homo sapiens
  misc_feature: GZ8MTXP01BWAES.44.36.D03.1.454.CMB.2.raw
  modified_base (261)..(261): a, c, t, g, unknown or other
  modified_base (345)..(345): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccactgtgaggtgcggctggtggagtcgtgggggagcgttggtacgaggcggggggtccctgagactctccgngtgcagcctctggattcatcttcagtgactatgccagtgaactgggtccgccgaggctccggaagggggacgggggcgtagggnggttcgggtttaccaagttagttagttaaattgttacgcgttgggacgtaacttaacccaacccgttaacgtaaccggacaacggtaccttacgttacggtacgggtaaacgggggcccctaaacttttaccccggaaacccttaaaacgtttaccccgggaaacgggggtaaacctaaacggttaccggaaaccccgtaaaacggggtaaaacccttccggtaaacccgtttagggttaacttacccggtaaggggtaaaaattaccggaaaccgtaagtaccccggtagggaaaggaaccggaacgggaaacgggaccgttaaaccggggtccttgggttaacccctttcgtttaccgtaaggttaccgaagggtacgtacggtttccccgggggaactttaacgggtttcggg

SEQ ID NO: 438512 - DNA, 904 bp, Homo sapiens
  misc_feature: GZ8MTXP01CR5Z2.44.36.D03.1.454.CMB.2.raw
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccaggccgtgggacgggtccctgacgtctctcctgtgtcgcctctggacttcacatcagtcaccatatagtggacgtcgggtcccgcgacggccgtaccggaaggggggaacgggggcgtagggggaggttcgggtaccggttcggggacccggtaacgtaaaaacggttaaaaaaaccgtaaacgggtttacccgaccccgtaaggttaccctttttaaacacccgtaaaacgtaacgggtaaccggttaacccgggtccccgggttaccggttaccgttaggggttaaacggtaaaaaccgggacccccgttaaagggttaaaccctttacccccgtaaaccccccttcgttaaaccgaaaagggtacgttaaacgttaacggtaaaccctttaacgaaaaacgttaacccttagttaacttttaggggtaacttttcccggtaagaacggttaaaacgttaaccgtaaaaccccgtttaaaccggtaaaaccgggaaaaacccgggtaaacgggaaccggtaaaccggggtcttaaagtttagggtttaaagttttaggtttacgggttttagggtttagttttaaccggttttaagttaacgtaacggtaaacggtaacgttccggtacccggttaccgggtaacgggggttaaccccgtaaacccggggg

SEQ ID NO: 438513 - DNA, 868 bp, Homo sapiens
  misc_feature: GZ8MTXP01C2RAF.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcgtaggttgggtgggaggtccgggggagtacgttggtccagccgtgggacgggtccctgacgactctcctgtcgtccgcctctggactcaccatcagtcaccatatagtggacgtcgggtcccgccgagggccgtaccggaaggggggaacgggggtcgtagggggacggttcgggtccgttcggggaccccggtaaccgtaaaacggttaaaaaaaccgtaaaggtttaccggacccgtaaaacgggttaccttttttaacgaaccgtaaaccggaaaacgggtaccgggtaacccgggtaccccgggtacggttacccgttaaggtaacggaaaaacggtccctaaaggtacctttaccccgaaacccctttctaaaccgtaaaacggaaggtaacttacggtaaacccttttaaccgaaaaacgggtttaacccttaccgtaaattttaccggtattttaccggaccggtaaagttaaacgtaacgtaaaacccgtttaaacccggaaaccgggaaaaaaccgggtaacgggaaaccgttaaccgggggtacttaaaggtttaacggtttaattttaaggtttttggttaacggttttgggtttaactttttaacgttaagttaccggttaaacggggttaaaccttccgggttaaaccccggg

SEQ ID NO: 438514 - DNA, 672 bp, Homo sapiens
  misc_feature: GZ8MTXP01E1RDT.44.36.D03.1.454.CMB.2.raw
  modified_base (349)..(349): a, c, t, g, unknown or other
  modified_base (358)..(358): a, c, t, g, unknown or other
  modified_base (427)..(427): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagacgaccctcacgctgacctgcaccatctctgggttctctctcaacgatattagaatgggtgtgagctggatccgtcacgcccccgagggaacggccctggagtggcttgcacacatcttctacgaatagaaacgaaaaatcctaacagtacatctctagaagagactaacgtttaaaccatacctaccaaaggaccaacctaccaaaagctaggtgtactttaagtatagaacccaanagtcgaccnggacgaacacgaggacaacatattaaactgtcgacgtaacgggtaaatcgggaacgggaaaagaaaccnggtacttggtttactaggttaattattaagttacctactatcgtaggacgtcgtaggggaacgaaacgggggccgtaacgggtccaaccggttcctcccgtacgacgtacccttaccgaacccggaaccgggccctaacggttcccggtccccgtttccccggcggccccgtcccgtcgacccgttccgaagggtccgacccgtaacccggttcggggaccggggacaaccggcgggtccccggg

SEQ ID NO: 438515 - DNA, 604 bp, Homo sapiens
  misc_feature: GZ8MTXP01CZWHG.44.36.D03.1.454.CMB.2.raw
  modified_base (308)..(308): a, c, t, g, unknown or other
  modified_base (345)..(345): a, c, t, g, unknown or other
  modified_base (374)..(374): a, c, t, g, unknown or other
  modified_base (382)..(382): a, c, t, g, unknown or other
  modified_base (427)..(427): a, c, t, g, unknown or other
  modified_base (480)..(480): a, c, t, g, unknown or other
  modified_base (525)..(525): a, c, t, g, unknown or other
  modified_base (530)..(530): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacttggtccagccgtggagggtccctgagactctcctgtgtcgcctctggattcaccatcagtcgaccactatagtggactgggtcccnccaggctccgagggagggctgggagtggctggccganaaagtaaaacaagttcgaccagtctttancaaacagngtaccgccggcttcgtagtagaaacgcccagtacttccgaccctntacgaaagagacttgacttacgaaagtaaccttctaatttcgggattttccgngtaaccgaataccgaaactaaccgtaaggaaaacccgtggaaccncgggntaattgttatttattggttgttcttagttacttatcaagggtaacttcgccgacggtcggggaaccctaacggg

SEQ ID NO: 438516 - DNA, 601 bp, Homo sapiens
  misc_feature: GZ8MTXP01BSXTV.44.36.D03.1.454.CMB.2.raw
  modified_base (275)..(275): a, c, t, g, unknown or other
  modified_base (301)..(301): a, c, t, g, unknown or other
  modified_base (392)..(392): a, c, t, g, unknown or other
  modified_base (444)..(444): a, c, t, g, unknown or other
  modified_base (527)..(527): a, c, t, g, unknown or other
  modified_base (570)..(570): a, c, t, g, unknown or other
  modified_base (580)..(580): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagccgtgggagggtccctgagactctcctgtgtcgcctntggatcacatcagtgaccactatagnggactcgggtccgccaggctccgaggggaaggggctgggagtggcttggccgacaaaggtaaaaaacaagttcgaccctaaagtctttaancaacgagacgtaccgcgcgtctagtagaaagtcccaagtacttcgacccctntacaaggacatcgaacttacgaaagtaactctaattgtaattcctgacgtaaatcggaaaccttaaaccgacgaaaaaccggnggaacgaccgggattaagttagtatttagttgttgttaagttntttaatagtnacgggtaacttcgtaacccgg

SEQ ID NO: 438517 - DNA, 728 bp, Homo sapiens
  misc_feature: GZ8MTXP01AG2L5.44.36.D03.1.454.CMB.2.raw
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcacgcccaccctcagtctcagtcggccccgaggggacgacggccaggattaccgtggtgggggcgacggtccggttggaggtaaagtgtacagtggacagcagagcaggccagccctgcgcgtggtcattctttcgaggtaataagtaacggccggccctaggagggtactcccgtggacgcgtccttcgtcgtcggtcctacctaacgtccggtacgggaaaaccgaccgggccctaccgtcgtacgaaccctacgtccgacgggccccgacccggaaccccacggccccgttcggtacgggtacgtacgggacggtcgttaggtaaccttacgttacggtcgtacggaaacggggtacggggtaaggggtaagttagtacgttaagggtttcggggtacgggttcggggacgggtacgggaccgaacggtccggttcggtaacccggttcggtccggttacgaccggtaaccccgagggttccccgttaccccggttccccgttccgggtaaccctacccgttcccgttacccggttcccccttaacccgtttaacccc

SEQ ID NO: 438518 - DNA, 628 bp, Homo sapiens
  misc_feature: GZ8MTXP01DRO5C.44.36.D03.1.454.CMB.2.raw
  modified_base (424)..(424): a, c, t, g, unknown or other
  modified_base (477)..(477): a, c, t, g, unknown or other
  modified_base (485)..(485): a, c, t, g, unknown or other
  modified_base (506)..(506): a, c, t, g, unknown or other
  modified_base (519)..(519): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcgaggttggtgggaggtccgggggagtacgttggtccaggccgtgggacgggtccctgagactctcctgtcgtcgcctcgtgatcacatcagtcgacctactatagtggacgtcgggtcccgccgaggcctaccggagggggaacgggggctggggaggttcggcgttcgggacccgaccgaaaaggtaaaaaacgaaggttcgaccctaaagtccttttaancaaacgaaggacgtaccgcgtcgtctgtagaaacgccaagtacttacaccctntacaaganatgacttacaaaggtaacctntacttgatttcgngacgaaatcgtaaaccttaaccgaacgaaaaccggtaagacgacgggtcaagttggtatttagttgttgtttaagtagtttaacagtcgaaggtaacgttcgtaacccg

SEQ ID NO: 438519 - DNA, 657 bp, Homo sapiens
  misc_feature: GZ8MTXP01AZUTI.44.36.D03.1.454.CMB.2.raw
  modified_base (277)..(277): a, c, t, g, unknown or other
  modified_base (408)..(408): a, c, t, g, unknown or other
  modified_base (483)..(483): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagtacgttggtccaggccgtggagggtccctgagactctcctgtgtcgcctntggatcaccatcagtgaccactatatggactgggtccgccgaggcctaccggagggggaacgggggctaggggagtcggcgttcgggaccgacgaaaggtaaaaaacaaggttcgacccaagtactttaanactaacgagacgtaccgccgtcgtactagtaacgaaacgcctaagtaactttcccaaccccttctacgaaagganatacgtaacttacaaagggtaactactaatttagaattccgtagaccgtaaatcggtaaaccctaaaccgtaacggaaaaacccggaaggaaacccgacggggtacttagttagttaatttagttggttacgtttggtattttaatagtacgttaggtaaccgttgtaacccgg

SEQ ID NO: 438520 - DNA, 696 bp, Homo sapiens
  misc_feature: GZ8MTXP01C5XVW.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaaacgaaaatcctaacagtacatctctagaagagactaacgtttaaccatcctaccgaaacggacaaccctaccgaaaaggctagggtggttactttaagtactacgaacccaaacgacgttacggaccctcggacggaccaaccgaggacaactaacttacttaactgtcggacgtaacggggtaaagtacgggaacgggaaaagaaacgacggtacgttagggtttacttagttaatttaagttaacgttacctttaactagttcgtacgggtacgtcggtaggggaaccgaaacgggggtacccgacggttaccacccgtcctacccgtcgacgtacctccgaaccgacggccctacgtcccgtcccgttccccggtcgcccgtcccgtcgcccgttccgacggtccgacccgtaaccggttccgggcgggggcctaaccggccgggtcccggg

SEQ ID NO: 438521 - DNA, 748 bp, Homo sapiens
  misc_feature: GZ8MTXP01ANHI4.44.36.D03.1.454.CMB.2.raw
  modified_base (177)..(177): a, c, t, g, unknown or other
  modified_base (198)..(198): a, c, t, g, unknown or other
  modified_base (228)..(228): a, c, t, g, unknown or other
  modified_base (240)..(240): a, c, t, g, unknown or other
  modified_base (254)..(254): a, c, t, g, unknown or other
  modified_base (263)..(263): a, c, t, g, unknown or other
tcagacagtatatacacgaccggtgctcgatttagctgcgtcacgatctctcttgggggtgggcacaagaggcagcactcaggacaatctccagcatggcctggtctcctctcctcctcactctcctcgctcactgcacagggtcctgggcccactctgtgctgacgcagccgcctnagtgtcgtcggggccccgggnaggaggtcaccatcctcctgcacgtgggancagactccaaanatcccgggggaaanagtattcgngtatcgtaccacgtacggaaccaactaccctacgaacggaaccaccgaaccccctaaactcctactacttacgtttaacgaaacctacgtacgtcccggtacccgtacggtaccggggttcccccctaggtaccgttacttccgtccgttaccgggtacctaaccgtacggtccgtacggacccctaacccgtcgacccgtcccccgtacccgtacgtaccctacgtccgtaccggtcggggtaccctaccggtacggtacgtaagggaaacgtagggttacgggtaagggttacggttaactttaacgttccgtaccgtaaccgtaacgtttaccgttaacgtacgtacgtaccgtccgtaccgtccgtaacggttagggttcggggttcggggttacgggtaccgggggtaacgggaacgggttacgacggtccggtaccgggtcccggttcgggtacggaccgtaaccggccccggtaacgg

SEQ ID NO: 438522 - DNA, 748 bp, Homo sapiens
  misc_feature: GZ8MTXP01DBQTP.44.36.D03.1.454.CMB.2.raw
  modified_base (286)..(286): a, c, t, g, unknown or other
  modified_base (291)..(291): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgttattttacgaaggtgtccagagtgaagtgcgtagttggtggaggtccgggggagtacgttggtccacgccgtggacgggtccctgacgactctccgtgtgtcgctgtgntcacntcatcgaccactatagtcggacgtcggccgccgaggccgtaccggagggggtaacgggggtcgtggggagttcgggtcgttcgggacccgtaacgtaaaaggtaaaaaacgtaggttcgacccgtaaagttaccttttaacgacgaccgtaaaggtacggtaacccgccgggtacgtcgtagggtaacgaaaccgtccgaaagttacctttaccccgaaccccttcgtaaccgaaaggaacgtaactacggttaaacctttaaccgaaaacggttaacccttagttaacttacggtaaactttcgtacgacgttaaaagtccgtaaaacccgttaaaccgaacgggaaaaaccccggaaggaacccggaacgggtcttaagtttaggtattttaggtttgttaacggttttgtttaagtttaatacgtacgttaacgggttaacttcggtaacccgg

SEQ ID NO: 438523 - DNA, 785 bp, Homo sapiens
  misc_feature: GZ8MTXP01EV3UH.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtgggacgggtccctgagactctcctgtgtcgcctcgtggatcaccatcagtgaccactatatggactgggtccgccgaggctacccggagggggaacgggggctgggagtggtcgttgggaccgacgaaaggtaaaaaacaaggtttcgacccctaaaggttcctttaagtaccaacgaggtaacgttaccggccccgtacgttctagggtacgaaaacggtccccaaaggtactttccccgaaacccccgttcttaacccgaaaaggaacgttaacgttacgggttaaaaccttttaccgaaaaacggggtaaaccccttttaacgtaaacgtttttacggtaaacttttcccgtaggtaacccgttaaaagttccgggtaaaaacccttaaaccccggttaaacgggaaaaaacccccgggtaaggggaaacccaaaccgggggtaccttaaagttaggtttaacttttagtttggtttagttttaagggtttagtttttaaccttagtaccggttaacgggttaaccgtttcgggtaaccccg

SEQ ID NO: 438524 - DNA, 796 bp, Homo sapiens
  misc_feature: GZ8MTXP01AGWIP.44.36.D03.1.454.CMB.2.raw
  modified_base (425)..(425): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtggaggtccgggggagtacgttggtccagccgtggacgggtccctgacgtactctcctgtgtcgcctgtggactcaccatcagtgaccactatagtggactgggtcccgccaggcctaccggaggggacggggtctagggagtcggcgttggggacccgtaacgtaaaggtaaaaaaacgtaaggtttcgacccctaaaggttacctttttaanaccgtaaacccaaggggtaaccgttaacccgggcccgggtaccggttacgttacggttaaacgggaaaaaccgggtcccctaaagggttaacctttaccccaaacccccggtttactaacccgtaaaagggaacgtaaacgttacgggtaaaccctttaacgaaaacggggttaaccttaaccgttaatttaccgtaatttacccgtaggtaaccgtaaagtccgtaaaacccgttaaacccgtaaacgggaaaacccggaaggaaacccgttaccgggggacttaaagttagggtttaatttagtttgggttagtttaaccggtttagtttaactagtacgttacggggttaaccttggttaaccccggg

SEQ ID NO: 438525 - DNA, 594 bp, Homo sapiens
  misc_feature: GZ8MTXP01DT0L0.44.36.D03.1.454.CMB.2.raw
  modified_base (275)..(275): a, c, t, g, unknown or other
  modified_base (291)..(291): a, c, t, g, unknown or other
  modified_base (385)..(385): a, c, t, g, unknown or other
  modified_base (440)..(440): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtccggtcaccatctcctgcactggagccagacgttaatattcttagtcttaactttgtctcctgtatcaacntcatccaaggtaaacncccccaaatcatcatctatgaggacctagtaagaggtccctgtagggtttctaactcgtcttcactcgaccctaccgaacgtccgaccaaaccnccggtccctcctgaacctacttcgtcgtcgggcctccgaggccgtaggagacggnggtactagtatttatttagtttcgttgcttacgtagtgttcgtttacgcgtctacttactactttagtcggtttacgttacggggtaacgttcgggaaccgttaacgttccgaccgttcggtaaggctaagttgtacgacttaagaaggtaacg

SEQ ID NO: 438526 - DNA, 714 bp, Homo sapiens
  misc_feature: GZ8MTXP01DT3IL.44.36.D03.1.454.CMB.2.raw
  modified_base (260)..(260): a, c, t, g, unknown or other
  modified_base (301)..(301): a, c, t, g, unknown or other
  modified_base (380)..(380): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcggctgagcgtgggttttccttgttgttatttacaaggtgtccagagtgaagtgcagttggtggagtccggggagacttggtccagccgtggaggtccctgagctctcctgtgtcgcctntggatcaccatcagtgaccactatagtggacgtgggtcccncgaggctccggaggggaaggggctgggagtgggcttcgggccgactaaaggtaaaacaaggttcgaccctagtctttanaccaaacagtaacgtacgcccgcgtctgtagaaacgccagtacttccaccctataccaaggacgtatacgtaacttacgaaaactaccttacgtagtttagtactttccgtagacccgttaaagtcgaaacccgtttaaaccggtaaacggaaaaaaccccggtggggaaacccgtaaacccgggggtattaaacttttaaggggtttaattttaaaggtttttggttgggttttttaagttaccgggttttttaaattaccgttaaccgtaaaaggtaaccgttttccgggacccgacggggtttcgggggaaccccgtttaaacccgggggg

SEQ ID NO: 438527 - DNA, 703 bp, Homo sapiens
  misc_feature: GZ8MTXP01BW43P.44.36.D03.1.454.CMB.2.raw
  modified_base (330)..(330): a, c, t, g, unknown or other
  modified_base (400)..(400): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacatcttctcgaatagaacgtaaaatcctaacagtacatctctagaagagactagtttaaccatctaccaaggaccacctacaaagcaggtgtacttagtatcgaccanagtacgacctgacgacacgagacactatacttaaactgtgacgtaacgggtaagtaggaacggggaaaanaaacgagtcgttagggttactagttaatttataaagttaccgttaacctagttcgttacgggacgtacggttagggggaaccgtaaacggggggacccgtaaccgggtaccgtacccgggttcctacccgttcgaaccggttacccttacccgaacccgggtaaaccggtcccgtacgttaacccgggttccccttcccccgtggggcccctacccgttcgacccgttcccggaacgggtaaccgtaccccgtcccggttacggggtccgggggacctaacccggaaccggggtcccccgggg

SEQ ID NO: 438528 - DNA, 725 bp, Homo sapiens
  misc_feature: GZ8MTXP01EOLQL.44.36.D03.1.454.CMB.2.raw
  modified_base (264)..(264): a, c, t, g, unknown or other
  modified_base (268)..(268): a, c, t, g, unknown or other
  modified_base (271)..(271): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagacgttggtccagcctggagggtcctgagactctctgngtcnctntggatcacatcagtcgaccatatagtcggacgtcggggtcccgccagggctaccggagggggaacgggggctagggaggtcggtcgttcggggacccgaacgaaaaggttaaaaaaacgtaaggttcgacccctaaaggttaccttttaagccaaaccgaaggaaccgttaccggcccggtagtcctaggtacgaaacgtccaagtacttccaacccctctacaagagtatagtaacttacgaaacggtaaacttcgtaatttagaactttccgaggaccgtaaaagttcgtaaaacccgttaaacccgtaaacgggaaaaaacccggaagggtaaccgaaaccgggggtacttaaaggtttacgttaagttttaagttttgggtttaggttttaacgttaggtttttaataacccgttaggttaaccgggttaaacctttcgggtaaccccgg

SEQ ID NO: 438529 - DNA, 750 bp, Homo sapiens
  misc_feature: GZ8MTXP01EGNV0.44.36.D03.1.454.CMB.2.raw
  modified_base (285)..(285): a, c, t, g, unknown or other
  modified_base (327)..(327): a, c, t, g, unknown or other
  modified_base (711)..(711): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtccagagtgaagtgcgtaggttgggtggacggtccgggggagtacgttggtccagtccgtgggacgggtccctgacgtactctcctgtgtcgctntggactcacatcagtcgaccatatagtggacgtcgggtcccnccgaggctaccggagggggaacggggctggggagttggcgttaggacccgtacaaacggttaaaaacaaggttcgaccctaaagttctttaagtaccaacgaaggtacggtaccgccggtacgtcgtagtaacgaaacgcctaagtacttacccgaaccccttcgtacgaaaggagtaacttcggtaaacctttaacgaaaacggggtttacccttcgttaaaagtttgggtaaactttaccgtcggtaaccggtaaaatttccgtaaaacccgttaaaccgtaaacgggaaaaaaccccggtaagggaaccgttaaaccgggggatttaaaggttaggtttaaattttaggtttgttagggttttaagttaaacgtttttaanaacggtacgttaacgggttaaccttcggttaaccccggg

SEQ ID NO: 438530 - DNA, 607 bp, Homo sapiens
  misc_feature: GZ8MTXP01ALKDK.44.36.D03.1.454.CMB.2.raw
  modified_base (516)..(516): a, c, t, g, unknown or other
  modified_base (541)..(541): a, c, t, g, unknown or other
  modified_base (558)..(558): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagacgttggtccagccgtgggacgggtccctgacgactctcctgtcgtcgcctcgtggatcacatcagtcgaccactatagtggacgtcgggtcccgccgaggccgtaccggagggggaacggggctggggaggtcggcgttagggcccgaacgtaaaggtaaaaaacaaggttcgacctaagtaccttttaagcaacgagtacggtacgcccgtacgtctagtagaaacgccaagtacttccaccctctacaagtagactagacttacgaacgtactcgattgacttcgngacaatcgaactaacgacgaaacgngacgcggacttgtagtnttagttgttagtttgtagtttaatatagacggtaacttcggtaacccgg

SEQ ID NO: 438531 - DNA, 752 bp, Homo sapiens
  misc_feature: GZ8MTXP01B7I8T.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgtctgggttttccttgttgcttatttagagtgtccatgtgaggtgcggctggtggagtcgtgggggagcgttggtacgagggcgggggggtccctgagctctcctgtcgcagcctctggattcatcttcgagtcgactatcgacctagtcgaacgtcgggtccgaccgaggccgtaccggagggggaacggggtcgtaggggtaggtttcggggtttaccagttagtaggtttaaatagttagcgtaagggaactaacctacccaaccctaaccgtacgactaacgtacctttcgtagggttacgggaaccggggtccttaaatttaaccccgaaccgttaaaacgttccccgggaaagggtaaccctaagtaccggaacccctaaaaggggtaacccttacgtaaccgttaggtaaactttacccggaaagggtaaaacgttacggaaaccgtacggtacccgtaagggaaacgggaaacggaaaccgggaacgggaacccgttaccgggtacgttcggttaccgtttacgtttaccgttggttaaccgggaagtaaacggtccgggttaccgggtaacccttaagggttttaaccggg

SEQ ID NO: 438532 - DNA, 838 bp, Homo sapiens
  misc_feature: GZ8MTXP01A293B.44.36.D03.1.454.CMB.2.raw
  modified_base (354)..(354): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacatcttctcgaatagaacgtaaaatcctaacagtacatctactagaagagactaacgtttaaccatacctaccaaacggaccaacccgtaaccgaaaaggcagggttggttactttaaggtatagaaccaanagtcggacctgacggacaccgaggcactatattaactgtcgacgtaacgggtaagtacgggaacgggaaaagaaacgtagtccgtttagggtttaccttaggttaatttaagttaaacggtttacctttaaaccctagttaccggttacgggtaaccgttacgggttacggggggaaacccgtaaaacggggggggggtaacccctaaccggggttacccgtaaaccccggttccttaccccgtacgtaccgtaccccgtttaaccccgaaaccccggtaaacccggggtccccctaaacggtttcccccgggttcccccgttttccccccccgggttcggggccccccggttaccccttaccggggttcccccttaccccgggttaaccgggaacccggggtccccctaaaccccgggttttcccgggggtccgggggggggacccctaaaccccggggttccgggggtaacccccccggggg

SEQ ID NO: 438533 - DNA, 610 bp, Homo sapiens
  misc_feature: GZ8MTXP01BKS8J.44.36.D03.1.454.CMB.2.raw
  modified_base (270)..(270): a, c, t, g, unknown or other
  modified_base (273)..(273): a, c, t, g, unknown or other
  modified_base (310)..(310): a, c, t, g, unknown or other
  modified_base (459)..(459): a, c, t, g, unknown or other
  modified_base (471)..(471): a, c, t, g, unknown or other
  modified_base (488)..(488): a, c, t, g, unknown or other
  modified_base (545)..(545): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttagttatttacaaggtgtcagagtgaagtgcagttggtggaggtccgggggagacgttggtccagccgtgggacgggtccctgagactctcctgtgtcgcctntgntcacatcagtgaccactatagtggacgtcggggtccnccgaggcctccggagggggaacgggggctgggggagtggtccgttcgggaccgacccgtaaaggtaaaaaacaggttcgacccgtaaagtccttttaagacacgaagtagtaccgcgtcgtagtgagaaacgccagtacttccaccctntacaagagatanacttacgaaagtacctntattgtattctagacaattacgaacctaaaccgaacgaaaacggcggaacgacgggnaagtgttaattgtttgggttgtttaagttagttaactagtacgttaacggtaacgttcgtaaccg

SEQ ID NO: 438534 - DNA, 717 bp, Homo sapiens
  misc_feature: GZ8MTXP01A48VE.44.36.D03.1.454.CMB.2.raw
  modified_base (275)..(275): a, c, t, g, unknown or other
  modified_base (287)..(287): a, c, t, g, unknown or other
  modified_base (317)..(317): a, c, t, g, unknown or other
  modified_base (415)..(415): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcttgggttttccttgttgttattttacaaggtgtccagagtgaagtgcagttggtggaggtccgggggagacgttggtccagccgtggacggtccctgagctctcctgtcgtcgcctntggactcacctntcagtcgaccactatatggactggggtccnccgaggcctccggagggggaagggggctgggaggttcggcgttcggggccgacgtaaaggtaaaaaacaaggtttcgaccctaaaggtaccttttaanccgaaacgaggaacggtacccggccggtcgttactagtaggaaaacgccctaaggtactttaccaaccccttctaccgaaagtacgacttacggtaactttaccaaaagggttaaccctgtaaactttggtaaactttcgtacggtactaaaacgttactaaaccgtttaaacccgtaaacggaaaaaccgggaacggtaaaccggaacggggtacttaaggtttaaggttattttaaggttgtttacggttttggtttagtttaatttagtccggttaaagggtaactttcggtaacccgg

SEQ ID NO: 438535 - DNA, 684 bp, Homo sapiens
  misc_feature: GZ8MTXP01DW859.44.36.D03.1.454.CMB.2.raw
  modified_base (274)..(274): a, c, t, g, unknown or other
  modified_base (283)..(283): a, c, t, g, unknown or other
  modified_base (291)..(291): a, c, t, g, unknown or other
  modified_base (542)..(542): a, c, t, g, unknown or other
  modified_base (577)..(577): a, c, t, g, unknown or other
  modified_base (610)..(610): a, c, t, g, unknown or other
tcagacagtatatacacgaccggtgctcgatttagctgcgtcacgatctctcttggggagctctgagagcggagccccagccccagaattcccaggttgttttcattttggtgatcagccactgaacacagaggacctcaccatggagttcgggctgagtcgttggttttccttgtttgttattttacaaggtgtccagagtgaagtgcgtaggttggtggaggtccggggatacgttggtccagccgtggacggtccctgagactctccgtgngtccgctgngatcaccntcaagtcgaacccactatagtcggacgtcggtcccgccgaacggccgtaccggaagggggaacgggggtcgtagggggtacgttcggggtaccgttggggacccccgtaaagaaaacggtttaaaaaaaaccgaaaggtttcggaacccctaaacggttccttttaagaccgtaaacgacgtaaccgggtccgcccggttcgtcgtaggtaacgaaacgtcccagttacttacccaacccttcagaaaganactgtaacttacgaaagtaacttgtaattgtactntgacctaaattcaaaccttaacgacgaaaccgnggacgcgggtattaagtggttatttagtttggttatttcgttagttaacttagagttagtaaccgttgtaaccg

SEQ ID NO: 438536 - DNA, 726 bp, Homo sapiens
  misc_feature: GZ8MTXP01EZOYT.44.36.D03.1.454.CMB.2.raw
  modified_base (247)..(247): a, c, t, g, unknown or other
  modified_base (264)..(264): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcactcaggacacgagggtcctgggcccagtcctgccctgactcagcctgcctccgtgtctggttctcctggacagtcgatcacctatctctgcacgtgggccagcaatgacagtgganatatactgtctctgtanacaacaacactaccagaccaaacgacccccaaactctaattacgtttttagacgtaccgtaggtgacgcggtccgtcgtacggttacgtttactaagtcgtcctttcgtcgttcggtacctaccgtaaacgtccgtacgggacccctaccgtacccgggtcccctttcccgtgtaaccggtacttcccgttcgtaccggggtcccttcccggggtcccgttagggaaccgggacggtcggtaccgttacggggttacctttaacgtttaccgtcggtaccttcggtaccctttacttaaacgtttaaccgtaaacctttccggttaggtaacggttccgggttttagggggttccggttacgggggttacgggtaacgggtacccttaccgttcccgttaccgggtcccgttaccgtaacgggtccgaaccggacccgtaaccgggttcccgttcccccggg

SEQ ID NO: 438537 - DNA, 809 bp, Homo sapiens
  misc_feature: GZ8MTXP01DIZ1D.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccagtggagttcgggctgagtcgttgggttttccttgtttgtttattttacgaaggtgtccagagtagaagtgcgtaggttggtagggacggtccgggggagtacgttggtaccacggtccgtagggacgggtccctggacgacttctcctgtcgtcgcctgtggatcacatcagtcgacactatatggacgtggtcccgccgaggaccgtaccggagggggacgggtcgtggggtagtcggtccggtttcggaacccgaaccgtaaaaacggttaaaaaacgtaacggtttccgaacccgttaaacgggtttacctttttaacgaccgtaaacgtaaaccgggtaacggtttacccccggacccgggtaccggttacgttacgggttaaacggaaaccggtacctaaacggtacctttaaccccgaaccccgtttacaacgtaaaacggaggttaacttacggtaaaccttaacggtaaaacgtaaccgtttactaaagtttaccgtaattttccgaacgtaacgtaaaacttacccgggtaaaaccttaaacccggtaaacgggaaaacccggaacgggaaccgacgggggtacttaaggttagtttaagttagttggtttagtttgttaacgtttaatacgtcgaacggttaaccgttcggtaacccggg

SEQ ID NO: 438538 - DNA, 531 bp, Homo sapiens
  misc_feature: GZ8MTXP01D2AQV.44.36.D03.1.454.CMB.2.raw
  modified_base (204)..(204): a, c, t, g, unknown or other
  modified_base (259)..(259): a, c, t, g, unknown or other
  modified_base (294)..(295): a, c, t, g, unknown or other
  modified_base (297)..(298): a, c, t, g, unknown or other
  modified_base (300)..(300): a, c, t, g, unknown or other
  modified_base (302)..(302): a, c, t, g, unknown or other
  modified_base (310)..(310): a, c, t, g, unknown or other
  modified_base (313)..(313): a, c, t, g, unknown or other
  modified_base (323)..(323): a, c, t, g, unknown or other
  modified_base (332)..(332): a, c, t, g, unknown or other
  modified_base (364)..(364): a, c, t, g, unknown or other
  modified_base (404)..(404): a, c, t, g, unknown or other
tcagacagtatatacacgaccggtgctcgatttagctgcgtcacgatctctcgttgggggggggtcacaagaggcagcgctctcgggacgtctccaccatggcctgggctctgctgcctcctcactctcctgactcaggacacgagggacctgggcccagtccgccctgactcagccagcctccgtgtctgggtctcctggacngtccgctcacctctcctgcactagaactatactgatgtagaaatataactgtctntgacaagtacaccaacgtaaccccactctacttannannanancgctgatnttncatcgtctcncgcgcctanagtctcgaacaactcggctgtagtatacttcngccctctcgtctacgacgacgacgacgtatattatcgctnctcagtcgtcggtacggtctagtagttgtgggtcgtcggtacgggcggtaccgcgtaacgcgttcgtcgttacgcgccgacgttccaccgtcccgtcggtaacctctcgttccgtccccttcgttcc

SEQ ID NO: 438539 - DNA, 721 bp, Homo sapiens
  misc_feature: GZ8MTXP01BC5MB.44.36.D03.1.454.CMB.2.raw
  modified_base (338)..(338): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctgggagtggcttgcacacatcttctacgaatagaacgaaaactcctaacagtacatctctagaagagctagtttaaccatcctaccaaggaccacctacaaaggcaggttgtacttagtatacgaccaanagtcggacctggaccggacaccgaggacacgtatacttaaccgtgtcgacgtaacggggttaactacgggaacggggtaaaacgaaacgtacggtacgtttacggttttaccgttaggttaatttaagttaaacggtttacctttaacccgtaacttaccggtacgggtacgttacggtacgggggtaaacggaaacggggggtacccgtaacgggtacccgtacccggttaccctacccgtccgtaccggtaccttaccccgaaccggtaaccggtacccctacgtcccggttcccttccccggtccggttacccgtccccgtcgccgttccggacgggtccgccgtaaccgtcgggtcgggggcctaacggcggtcccggg

SEQ ID NO: 438540 - DNA, 603 bp, Homo sapiens
  misc_feature: GZ8MTXP01ED11J.44.36.D03.1.454.CMB.2.raw
  modified_base (315)..(315): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctcaagacacctcaaagcaggtgtcttagatgaccaanatggacctgcggacaccgaggcacatattaactgtgcaacggggtaatgacggggaaaagaaacgagtcttaggtttctagttaatttaagttaagttacctttaaccctattcgtagggacgttcgttacgggggaccgaaacggggggacccgtacgggtccaccggtcctccctcagtcccttaccgaccgaacgggcccacgtccggtccttccccccgtggccgcccctgttcccgttccgacgggaacgtcccaacccgtccgacgacgccaacgaaccggg

SEQ ID NO: 438541 - DNA, 523 bp, Homo sapiens
  misc_feature: GZ8MTXP01BVOMY.44.36.D03.1.454.CMB.2.raw
  modified_base (332)..(332): a, c, t, g, unknown or other
  modified_base (341)..(341): a, c, t, g, unknown or other
  modified_base (347)..(347): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataactgtctcctgtatcaaacaacatccaggaccaaacgcccccaaatcaattactttttgacgtccagtgagcggcgtcaggtntttcaatcncttctntggctcaagtctggccacgaccgtcctcctgtcgatctgtcgggctccggctggacgcgagctggacttagtactgcgtctctatttaccatcttgagtcgttggggtcgttcgggcggttagggactcgaccgttcgaccgtcctaggtcacgcccagggtccttcggtcccccg

SEQ ID NO: 438542 - DNA, 781 bp, Homo sapiens
  misc_feature: GZ8MTXP01DHQPK.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccagtggagttcgggctgagtcgttgggttttccttgttgttatttacaaggtgtcagagtgaagtgcaggttggtggaggtccgggggatacgtttgggccagccgtgggacggtcctgagctctcctgtcgtcgcctgtggtactcaccatccagtacgacctactatagtggaccgttcgggcccgcgaggccgtaccggagggggaagggctggggtagtcgggtacgttcgggaccgtaaccgtaaaagtaaaaaaacgtaaggttcgaacccgtaaaggttacttttaacgactaaaccgaggtaccgttacccggcggtcgttaccgtaggacgaaacgtacccgaagttaaccttaccccaacccgtttactaaccgaaaggtaaacgtaacgttaacgtaaaccttaaccgaaaacggttaactttacgttaagtttacgttaacgtttaccgacggtaaaccgtaaacgttaaccgtaaaaccgttaaacccggtaaaaccgggaaaaacccgggtaacggtaaaccgggttacgggtaacttaagtttaacgtttaagttttagtttaggtttaggttttaacgttagttttaacgtaacgtacggttaacggttaaccgttaacggtaacccg

SEQ ID NO: 438543 - DNA, 681 bp, Homo sapiens
  misc_feature: GZ8MTXP01DHLWA.44.36.D03.1.454.CMB.2.raw
  modified_base (497)..(497): a, c, t, g, unknown or other
  modified_base (506)..(506): a, c, t, g, unknown or other
  modified_base (543)..(543): a, c, t, g, unknown or other
  modified_base (616)..(616): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagtcgttggttttccttgtttgtttatttacgaaggtgtccagagtgaagtgcgtaggttggtgggaggtccggggagtacgttggtccgagccgtggacggtcccgtgacgactctccgtgtcgtcgcctgtgactcacatcagtcgaccactatagtcggacgtcggtcccgccgaggccgtaccggagggggaacggggtcgtagggtaggtcggtcgttcggacccgtaacgtaaaacgtaaaaaacgtaagttcgacccgtaagttactttaagaccgaacgaggaacgtacccgccgtcgtacgtgtaagaaacgcctagtaccttacccaacccgttntacgaaagngtaacgtacgtaacctttaaccgaaaggtaacccttntaagtttagtattccgtagactaaacgttcgtaaaaccctaacgaaaccggaaaaccggaaggacgttacggnttagttgttaatttagttgtttagttaagttatttaatcgtacgttacgtaacgttcgtaaccgg

SEQ ID NO: 438544 - DNA, 710 bp, Homo sapiens
  misc_feature: GZ8MTXP01ANEB2.44.36.D03.1.454.CMB.2.raw
  modified_base (440)..(440): a, c, t, g, unknown or other
  modified_base (675)..(675): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagtcgttgggttttccttgtttgttattttacgaaggtgtccagagtgaagtgcgaggttggtgggaggtccgggggagtacgttggtccaggccgtgggacgggtccctgacgtacttctccgtgtgtcgcctcgtgtctcacatcagtcgaccactatagtggacgttcgggcccgccgtaggccgtaccggagggggaacgggggtcgtaggggaggttcgggcttcggggaccaacgtaaaaggtaaaaaacgaaggtttcgaccctaaagtaccttttaanccgtaaacgaggtaaccggttaccgggcccgtacgttacgtaggtacggaaaaccgtcccgtaagtacctttaccccgaacccttactaacgaaacggactagttacgtaactttaacaaaacgggttacttacgtatttacgtacttaccgtgacgtaaactcgtaaaccctaaaccgtaacggaaaacgaacggaacgcggtattagtgttaatttggttgttcgttaagttntttaagttacacgttacgtaacgttcgtaaccggg

SEQ ID NO: 438545 - DNA, 610 bp, Homo sapiens
  misc_feature: GZ8MTXP01EP8AB.44.36.D03.1.454.CMB.2.raw
  modified_base (288)..(288): a, c, t, g, unknown or other
  modified_base (386)..(386): a, c, t, g, unknown or other
  modified_base (526)..(526): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgttgttattttacaaggtgtccagagtgaagtgcagttgggtggaggtccgggggagacgttggtccagcctggagggtccctgagactctcctgtgtcgcctctgatcacatcagtnaccactatagtggacgtgggtccgccgaggctccgaggggaaggggctgggagtggctggccgacaaggtaaaaacaagttgaccctaagtctttaancgacagacgtacgccgtgttctgtagaaacgccagtacttccaaccccttctacaaagagactacggtaaactttcaaacgggacttcgtatttcgattcgtgacgtaaatcgaaacctaaaccgtaggaaaaacccggnggtaacgacgggacttagttgtaatttagtttgggttatttggttagtttaattacgtgttaacgtaaccgtttaacggtcccg

SEQ ID NO: 438546 - DNA, 559 bp, Homo sapiens
  misc_feature: GZ8MTXP01B75VT.44.36.D03.1.454.CMB.2.raw
  modified_base (306)..(306): a, c, t, g, unknown or other
  modified_base (385)..(385): a, c, t, g, unknown or other
  modified_base (476)..(476): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccatatatggactgggtccnccaggctccgaggggaggggctgggagtggcttgggcccgtacaaaggtaaaaacaaggttcgcctaaagtcttttaanccaacgagacggtaccgcccgtagtctgtagaaacgccagtacttccaacccctctacaagagatgacttacgaaggaactcattgattcngcgaatcgaacctaactagaaaccgaagacgacgggcagtgtattagttggttgttgttgtttaatatgacggtcttgtcccg

SEQ ID NO: 438547 - DNA, 739 bp, Homo sapiens
  misc_feature: GZ8MTXP01C3QYN.44.36.D03.1.454.CMB.2.raw
  modified_base (207)..(207): a, c, t, g, unknown or other
  modified_base (695)..(695): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccagtggagttcgggctgagcgtggtttctgttagtattacaaggtgtcagagtgaagtgcgtaggttggngggaggtccgggggatacgttggtccagccgtggacggtccctgagctctcctgtgtcgctgtgactcaccatcagtcaccactatagtggacgtcggtcccgccgacggccgtaccgggaagggggaagggggtcgtggggtaggttcggtcgttcgggacccgtaaacgtaaaaacggttaaaaaacgtaaggtttccgacccgtaaaaggttacttttaacgaactaaaccggaacggttaacggtacccggccgtacggttccgttagaagaaacgtcccgattacccttacccaaaccctttcgaagtaaagaccgtagtacgtaaactttaaccggaaagtttaaacccttagttaagttacgttaacgttacgaacgtaaccgtaaacgttaccgtaaaaccgtaaaccggaaacggaaaaccggtaacggaacggttacggttacttaagtttagtttaagtttaggtttgtttagtttntttaagttaacctacgtacgttaacgtaaccgttcggtaaccgg

SEQ ID NO: 438548 - DNA, 747 bp, Homo sapiens
  misc_feature: GZ8MTXP01C2NH0.44.36.D03.1.454.CMB.2.raw
tcagacagtatatacacgaccggtgctcgatttagctgcgtcacgatctctcttgggtcttgcccaggtcaccttgaaggagtctggtcctgtgctggtgaaacccacagacgaccctcacgctgacctgcaccatctctgggttctctctcaacgatattagaagtgggtgtgagctggatccgtcacgcccccgagggacgcctggagtgctgcacacatcttcacgaatagaaacgtaaaactcctaacagtacatctctagaagagactaacgtttaaccatacctacgaaacggaccaaccctaacgaaaaggcgtagggttcgttactttaagtatacgaacctaaagacgtacggaccctaggaccgaacaaccgacggacaactaattaacttaacgtggtcggacgtaaacggggttaaagacggggaaacggggaaaaacgtaaacgtacgtacgtttaggtttacttaaggttaattaattaaacgttacctttaacctagttaccgtacgggtacgttcggtaacgggggaacgaaaacggggggtacccgtaaccgggtacctaaccccgtcctacccgtaccgaaccgtacccgttacccgaaccggtaccggtccccgtaacggttccccggtccccgttcccccggtcgggccccgtccccgttcggcccttccggacgggaacctcccggtaaccgtcggggcgggggaccaaccggcccggggcccggg

SEQ ID NO: 438549 - DNA, 582 bp, Homo sapiens
  misc_feature: GZ8MTXP01B6Q61.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgcttgggttttccttgttgtcttattttagaaggtgtccactgtgaggtgcggctggtggagtcgtgggggagtcgttggtacgagggcgggggggtccctggagctctccgtggtgcagcctcgtggattcgatcttcgagtgactatgccatgaacgtcgggtcccgccgaggcctaccggagggggagggtctgggagttgggtttccagtatgttaaatgttgctggagactaccacctactacgcagacttgtggtagagggcctataccactaattccgaggacaacgtagacccaaggactcgtaactcgtaatccgtaaggaaacttcgaaacgcgtacccgtaggaagaacggaacgagggaccacggtctgttccttcgttctgttacgaaggtagcgttcgggtccttaacggtttcgg

SEQ ID NO: 438550 - DNA, 643 bp, Homo sapiens
  misc_feature: GZ8MTXP01ETPVM.44.36.D03.1.454.CMB.2.raw
  modified_base (594)..(594): a, c, t, g, unknown or other
  modified_base (609)..(609): a, c, t, g, unknown or other
tcagacagtatatacacgaccggtgctcgattttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggacgccctggagtggcttgcacactattccttctacgaaatgaacgtaaaaatcctaacaagtacatctactagaagagctagtttaaccatctaccaaggaccacctacgaaaggctaggtgttactttaaggactacgacccaatacgtcggtaccctgaccggacaccgacggacaagtattacgttaaactggtcggacgtaacgggtaaagtacgggaacggggaaaagaacgtagtcgttaggtttactagttattataagttaccttacgattcgaggacgtgtaggggacgtaaacgggggcctaacgggtcaccggtctccacgacgtcctaccgaaccgtaacggccctaacggtccgttccgttccccgtggttcccgccgtacnccgttacgcggaacncgtaaccgtcggcggggactaacggcggtcccgg

SEQ ID NO: 438551 - DNA, 818 bp, Homo sapiens
  misc_feature: GZ8MTXP01E0GMK.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaaatcctaacagtacatctctagaagagactaagtttaaccatacctaccgaaaggaccaaccctaccgaaaagggtctagggttggttactttaagtatcgaacccaaactacgtacggacccctggaccggaacacccgacggacaacattaacgttaacttaggtcgacgtaacgggggtaaactacgggaaacgggggaaaacaaaacggtacgtacgtttacggggttttactaggttaaagtttaaactaacggtttaccttaaacccgtagttaccgttacggggtaccgtacgggttaacggggggaaccgtaaacggggggggtaccccgtaaccggggttacctaaccccgggttcctcccgttaccgaaccggtccccttaacccgtaaccggaacccggggtcccctaacggtttccccggggttccccttttccccccgggacggggttccccgtcccccgttccggttacccgttccccggaacggggtaacccgacccggttaaccccggttccggggtaccggggggccctaacccgggaaccgggggtcccccggggg

SEQ ID NO: 438552 - DNA, 573 bp, Homo sapiens
  misc_feature: GZ8MTXP01A8CL2.44.36.D03.1.454.CMB.2.raw
  modified_base (389)..(389): a, c, t, g, unknown or other
  modified_base (414)..(414): a, c, t, g, unknown or other
  modified_base (433)..(433): a, c, t, g, unknown or other
  modified_base (450)..(450): a, c, t, g, unknown or other
  modified_base (544)..(544): a, c, t, g, unknown or other
  modified_base (554)..(554): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccggggggagacttgggtccagccctgggaggggtcccctgagactctcctgtgtcgcctctggatcaccatcagtgaccactatatggactggggtccgccaggctccgagggggaagggggctgggagtggcttgggccgcaaggtaaaaacaagttgacccaagctttaancacagacgtaccgcgacgtctgtanaaagcccagattcaccctntcaaagacgatgacttnaaaggaacttcgatttggaatttctgacgtaaatcgtaaacctaacctacgaaaaccgaagggacaacggggcaagtgtattattcggttgttntgtttaatancttacggtaacttgtcccg

SEQ ID NO: 438553 - DNA, 699 bp, Homo sapiens
  misc_feature: GZ8MTXP01CHSAJ.44.36.D03.1.454.CMB.2.raw
  modified_base (186)..(186): a, c, t, g, unknown or other
  modified_base (195)..(195): a, c, t, g, unknown or other
  modified_base (203)..(203): a, c, t, g, unknown or other
  modified_base (235)..(235): a, c, t, g, unknown or other
  modified_base (274)..(274): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagagactcaccatggagttgggctgcgtcttgggttttccttgttgtcttattttagaggtntccatgtgnggtgcggntggtggagtcgtgggggagtcgttgggtacgngggccggggggtcctgagctctcctgtcgcagtcctcgngtattcattctgagtgactatgcctagtcgaaccgtcgggtccccgacgacggtcccgtacggagggggtaacgggtcgttaggggtaggtttggtttaccagtttagttagttttaatacgttgacgtggtaaagtaaccttaacccgtaaccttaaccgacgtacgtaaccggtacttcggttacggtaacggggtaacggggtaccctaaccgtttaccaaacccgttaacggtttaacccgggaagggtaaaccaagttacgaaacccgtaaaacggggttaacccttacgtaacgtttacgtaacgtaccgtaagggtaaatacgtaacgagtaccggagaaacggaagtaacggaggaccttcggtacttgttccttcgttcgtgttacgaagtagtccgttcgggtaaccttggttcg

SEQ ID NO: 438554 - DNA, 790 bp, Homo sapiens
  misc_feature: GZ8MTXP01E2WFL.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacacttcttctacgaatagaaacgtaaaaatcctaacagtacatctactagaagagtactaacgtttaaaccactacctaccgaaacggaccaaccccgtaacgaaaacggcgaagggttcggttactttaagtatacgaaccaacacgtacggaccctaggaccggacaaccgacggactaacgtattacgttaaacgtcggtaacgacggtaacgggtaaagtacggggaaacgggaaaacgaaacgtaggtacgtttaggtttacttaggttaatttaacgttaacgtttaccttaaccgtagttacggtacgggtaccggttacgggtaacgggggaaccgtaaaacgggggggtaccctaccggggtacccgtacccggttccttacccgtaccgttaaccgtttacccgaacccgggtaaccggtacccgtacccggttcccgggttcccccgtttcccccggttcgggtcccccgttcccgttacggcccttaccggacggacccgtcccgtaacccggtcggggtcggggacccgacggtccgggcccgggtccccgggg

SEQ ID NO: 438555 - DNA, 782 bp, Homo sapiens
  misc_feature: GZ8MTXP01BBH70.44.36.D03.1.454.CMB.2.raw
  modified_base (335)..(335): a, c, t, g, unknown or other
  modified_base (415)..(415): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtcggccccaggggacgacggccagggtactttaccgtggttcggggggcgaaccggtccggttagggaagggttaaaaagtgtaaccaggtcgggtaaccaggccaggaacgccaggcccacgaccccctgtcgctggtcatctattangagtggccgggccgccctgagtcgactcccttgccgcgtccttcccgtacccggctcccaacgtcgtaacggggaacccncccgggccctacccgtcggacccacgttccgacggcgtacgggggtccggaaccgggggtcccggggggaattcgggacgggtacccccggaagtttaacgttaaccccgtgggttacccgaaggtccgtttaggggaccggggggtaaactaaggggttaaccgttaggtacggtaacttaccggaaccgtttccccgggtaaggttacgggttaccggggaccgggggtaaggaacccgtaaacgggttccgtaaccgggttccccggttaccggttcggggcccgaccggttaccccggaaaggggtcccctcccgggtcccccccgttacggggttccctaacccgttcccgtttcccccggg

SEQ ID NO: 438556 - DNA, 682 bp, Homo sapiens
  misc_feature: GZ8MTXP01EEVA7.44.36.D03.1.454.CMB.2.raw
  modified_base (229)..(229): a, c, t, g, unknown or other
  modified_base (242)..(242): a, c, t, g, unknown or other
  modified_base (299)..(299): a, c, t, g, unknown or other
  modified_base (369)..(369): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctcacccaggacacagggtcctgggcccagtctcgccctgactcagcctgcctcgtgtcgtgggtcgcctggacagtcggtcaccatctcctgcacgtgganccagtacgtaatnttcttagtcttaacttgtctcctggtactacaacgtatacactaccaaggtaaaccncccccaaatcatacatctatcgagacctaagtaacgacgtcctagtaggggtttctaactcgtacttacncgtcgtaaccctactaacggtccgacaaccgtaccggtccctccacgtactaacttctaccggtcggaccttacgaagggtcctaagggacggaacggtaggtactagttaattttagtttaaggtttgttcggtaccttacgtaaagttgttccggtttacggtcgtactaacttacgttacctttaagtcggtttaacgtttaccggggaaggttacgggtaccgtaaacggttcccgttacccgttaccggttaacggacccgcccggtaacccgtaaccgggaccccttaaacccccttggtttccccg

SEQ ID NO: 438557 - DNA, 770 bp, Homo sapiens
  misc_feature: GZ8MTXP01AXKBA.44.36.D03.1.454.CMB.2.raw
  modified_base (278)..(278): a, c, t, g, unknown or other
  modified_base (288)..(288): a, c, t, g, unknown or other
  modified_base (327)..(327): a, c, t, g, unknown or other
  modified_base (530)..(530): a, c, t, g, unknown or other
  modified_base (571)..(571): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttcctgttgttatttacaaggtgtccagagtgaagtgctaggttgggtggaggtccgggggagtacgttggtccagccgtgggagggtccctgacgacctctcctgtcgtcgcctntggactcacngtcagtagacctagtatagtggaccgtgggtcccaccgngggactaccggaggggggaacgggggcgttggggacgttcgggtacgttcggggaccccgagtaaaacggtttaaaaaaaccgaaaggttttcgaaccccgtaaaagggttacctttaactcgaaacccgaaaggtaccggtaccgcccggtcgttacgtggtaaacgaaagtccccaaggtaaccctttcccaaccccgttntaacgaacgtagtacgtacgtaacttacgaaacggtacttntaagttctaacgtttcgacgtaacggtaaacgttaccgtaaacccgttaaaccggaaacgggtaaaacccgggtcgggtaaccggacggttacgttaatttagggttttacgtttaagtttggttttaccgtttaagggttaacgtttaacgttaacggtaccgggttaacgggttaaccgtttcccgggaaccccggg

SEQ ID NO: 438558 - DNA, 624 bp, Homo sapiens
  misc_feature: GZ8MTXP02J2INF.44.36.D03.1.454.CMB.2.raw
  modified_base (217)..(217): a, c, t, g, unknown or other
  modified_base (338)..(338): a, c, t, g, unknown or other
  modified_base (364)..(364): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctggtttcctgtgtatttacaaggtgtccagagtgaagtgcagttggtggagtccggggganacttggtccagcctggagggtccctgagactctcctgtgtcgcctctggattcaccatcagtgaccactatatggactgggtccgccaggctccgaggggagggctggagtggcttggccncagtaaaacaagttgccagtctttancacagacgtaccgccgtcgtctgtagaaacgccaagtacttcccacccctactacgaaagagtactacgtaccttacgaaagtaacctctaagtttcgtaactttccgaggaccgtaaagttcggtaaacccttaaaacccggtaaacgggaaaaacccggacgggaaacccggaaccggggactaagttacgttaactttacgtttggttacggtttaagtttagtttaactacgttacgaacggtaccttcgtacccg

SEQ ID NO: 438559 - DNA, 595 bp, Homo sapiens
  misc_feature: GZ8MTXP02JCKEM.44.36.D03.1.454.CMB.2.raw
  modified_base (216)..(216): a, c, t, g, unknown or other
  modified_base (301)..(301): a, c, t, g, unknown or other
  modified_base (335)..(335): a, c, t, g, unknown or other
  modified_base (363)..(363): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgtgtatttacaagtgtccagagtgaagtgcagttggtggagtccggggganacttggtccagcctggagggtccctgagactctcctgtgtcgcctctggattcaccatcagtgaccactatatggactgggtccncaggctcgagggagggctggagtggcttgggccncaagtaaaaacaagttgccagtctttancacagacgtaccgcgcgtctagtagaaacgccaagtacttcccaccctcacaaagagatacgtaacttacaaagtaactactattagtattacgtagtacgtaacgtacgtaactaaccgtaaacgaaaaccggaacggaacggaacggacgtaacgttacgttacgtttacgtttagtttagtttaaggtttagtttaagttacgttacgtaacggtaacgttacgtaccg

SEQ ID NO: 438560 - DNA, 609 bp, Homo sapiens
  misc_feature: GZ8MTXP02HW5UW.44.36.D03.1.454.CMB.2.raw
  modified_base (215)..(215): a, c, t, g, unknown or other
  modified_base (298)..(298): a, c, t, g, unknown or other
  modified_base (378)..(378): a, c, t, g, unknown or other
  modified_base (381)..(381): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtgagtccgggganacttggccagcctggagggtccctgagactctcctgtgtcgctctggatcaccatcagtgaccactatatggactggggtccncccagggctccgaaggggaaggggctgggagtggcttgggccgactaaggtaaaaaacaaagttcgaccaagtctttaancanagacgtacgcgcgtctagtagaaacgccaagtactaccaccctcacgaagagatagactacaacgaactactattagtattagtagacgaatacgtaactaaaccgtaaacgaaaacgaaacggaacgaacggaacgtacgtagttagttaagttagttagtttagttagtttaagttaagtaacgtaacgtaacgtacgtaccgtaccggtacgggtaccggaacgg

SEQ ID NO: 438561 - DNA, 522 bp, Homo sapiens
  misc_feature: GZ8MTXP02HOG0L.44.36.D03.1.454.CMB.2.raw
  modified_base (349)..(349): a, c, t, g, unknown or other
  modified_base (352)..(352): a, c, t, g, unknown or other
  modified_base (481)..(481): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccagggaaggccctggagtggcttgcacacatcttctcgaatgaacgaaaaatcctacagtacatctctgaagagcagtttaaccatctccaaggacacctccaaaaggcaggtggtctttagtatgacaacatgacctgcgacaccagcacatatacngtncacggtaatgacgggaaagaaacagctggttctgtatataagtcttaccatctggacgtcgtggggcaaaagggaccacggtcacgtctcctcacgcttccaccaagggccccaatccggtccttcccncgccgccctcgctccaggaaccgcacgtcgcggcacgcgcg

SEQ ID NO: 438562 - DNA, 614 bp, Homo sapiens
  misc_feature: GZ8MTXP02FXZTS.44.36.D03.1.454.CMB.2.raw
  modified_base (368)..(368): a, c, t, g, unknown or other
  modified_base (371)..(371): a, c, t, g, unknown or other
  modified_base (393)..(393): a, c, t, g, unknown or other
  modified_base (416)..(416): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttcctgttgttatttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaggggctgggagtggcttggccgcagtaaaacaagttgccagctttancanagagtacgcgcgtctgagaacncatactccaccctctacgaaganatacgtaaccttacgaaacgtaaccttactaagtttacgtactttcgaggtaaccgtaaagttaccgtaaacccttaaaacccgtaaacggaaaaacccggtacgggaaccgaacgggtactaaagttacgtttaagtttacgttggtttagtttaaggtttagtttaactacgtacgtaaggtaccttcggtacccg

SEQ ID NO: 438563 - DNA, 512 bp, Homo sapiens
  misc_feature: GZ8MTXP02JYNPB.44.36.D03.1.454.CMB.2.raw
tcagacagtatatacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacattggagatataaccttgtctcctggtatcaacaacatccaggcaaacgcccccaaatcatacttttgagtccagtgagcggcgtcaggtgttctaatcgcttctctggctcaagtctggccacacggccctccctgtcgatctcgtgggcctccggctgaggacgaggctgactattactgcgctctatttacaacttcttagagtacgttggggtgttcgggcggtagggactcgacctgaccgtcgtaggtcacgcccacggctcgtcccccg

SEQ ID NO: 438564 - DNA, 618 bp, Homo sapiens
  misc_feature: GZ8MTXP02GJJKY.44.36.D03.1.454.CMB.2.raw
  modified_base (220)..(220): a, c, t, g, unknown or other
  modified_base (283)..(283): a, c, t, g, unknown or other
  modified_base (370)..(370): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcgtgtaggtatttacaaggtgtccagagtgaagtgcagttggtggagtccggggganacttggtccagcctggagggtccctgagactctcctgtgtcgcctctggattcaccatcagtnacccatatatggactgggtccgccaggctccgagggaaggggctggagtggcttggccgaacaaagtaaaacagtcgactagtcttncacgagtacgtaccgccgtcgtctagtagaaacgccgtaagtacttacccaccctctaacaaagagtacgtacgtaaccttacgaaacgtaactactattagtattacgtacgtacgtaagtacgtaaccgtaaaccgtaaacgaaaaccggaaacggaacggaacggacgtaagtacgttacgtttacgttaggttagtttaagtttagtttaacgttacgttacgtaacggtaacgttacgtaccg

SEQ ID NO: 438565 - DNA, 524 bp, Homo sapiens
  misc_feature: GZ8MTXP02IOHHX.44.36.D03.1.454.CMB.2.raw
  modified_base (412)..(412): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcacccaggacacagggtcctgggcccagtctgccctgactcagcctgcctccgtgtctggttctcctggacagtcgatcaccatctcctgcactgggtccagcaatgacattgggagatataacttgtctcctggtatcaacaacatccaggcaaagccccaaatcatacttttgatccagtgagcgcgtcaggtcgttctatcgcttctctgctcaagtctgccacacgcctccctgtcgatcgtctcgggctccggcctggacggacgaggctgactattacngcggctcatttacaactcttgacgtacttggggtcgttcgggcggtacgggacttcgaccgtcggtaacccgtccgtaaggtcacgcccgaaggtcctccgtcccccgtcgg

SEQ ID NO: 438566 - DNA, 554 bp, Homo sapiens
  misc_feature: GZ8MTXP02G2M1J.44.36.D03.1.454.CMB.2.raw
  modified_base (347)..(347): a, c, t, g, unknown or other
  modified_base (375)..(375): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttgggtccagcctggagggtccctgagactctcctgtgtcgcctctggattcaccatcagtgaccactatatggactgggtccgccaggctccgagggaaggggctggagtggcttgggccncaagtaaaaacaagttgaccagctttancacagagtacgccgcgtctgtgaaagccaagattccaccctctacaaagagatgaactttcaaagtaactcaattgaattctagacgaaatgaacctaaaccgtagaaaaacccgaggacacggggacagtgtaattagttgtagtttgtgtttaactagtacgaggtaactgtacccg

SEQ ID NO: 438567 - DNA, 532 bp, Homo sapiens
  misc_feature: GZ8MTXP02FR8JD.44.36.D03.1.454.CMB.2.raw
  modified_base (353)..(353): a, c, t, g, unknown or other
  modified_base (376)..(376): a, c, t, g, unknown or other
  modified_base (444)..(444): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctacagtacatctctgaagagcagtttaaccatctccaagacacctaccaaaagcaggtgtctttagtatgaccaacatcggaccctgcggacaccagcacatatacngtgcacgggtaatgacgggaaanaacagactggttctgtattataagtctaccatctgacgtgtagggacaaagggaccacgtcaccgtcncctcacgcttccacgaacggcccagtccgtccttcccctcggcctccctcgacctccaggcgcaccgtcgtcggggccacgcgcccgg

SEQ ID NO: 438568 - DNA, 576 bp, Homo sapiens
  misc_feature: GZ8MTXP02IGDC9.44.36.D03.1.454.CMB.2.raw
  modified_base (303)..(303): a, c, t, g, unknown or other
  modified_base (459)..(459): a, c, t, g, unknown or other
  modified_base (489)..(489): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccncaggctccgaggggaaggggctgggagtggcttggccgacaagtaaaaaacaagttcgaccagtctttatcacagagtacgccgcgttctgtgaaagcccaagtattcccaaccctctacaaagacgatgaacttcaaagtactcaattgatttcngacgaatgaactaaaccgtgaaaaacccgnggaacacggggctaatggtaattagttgtgtttgtattttactatcgaggtaaacttcggtacctacggtcggggaccaaaccgggg

SEQ ID NO: 438569 - DNA, 561 bp, Homo sapiens
  misc_feature: GZ8MTXP02HSAWH.44.36.D03.1.454.CMB.2.raw
  modified_base (309)..(309): a, c, t, g, unknown or other
  modified_base (345)..(345): a, c, t, g, unknown or other
  modified_base (368)..(368): a, c, t, g, unknown or other
  modified_base (372)..(372): a, c, t, g, unknown or other
  modified_base (384)..(384): a, c, t, g, unknown or other
  modified_base (388)..(388): a, c, t, g, unknown or other
  modified_base (412)..(412): a, c, t, g, unknown or other
  modified_base (420)..(420): a, c, t, g, unknown or other
  modified_base (439)..(439): a, c, t, g, unknown or other
  modified_base (449)..(449): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttggtccagccgtggagggtccctgagactctcctgtgtcgcctctggattcaccatcagtgaccactatatggactgggtccnccgaggctccgaggggagggctggagtggctggccncaagtaaaacagtgcagctttancaanagacgtacgcgngtcngtagaaagccaagcttccaccctntacaaagngatgacttacaaagtactnattgatttcngacgtaatcgaaacttaaccaaggaaaacccgaggaaccgacgggactagttagttaagttagtttgtagtttggttacgttttaatagtcgaaggtaactttgtaacccgg

SEQ ID NO: 438570 - DNA, 517 bp, Homo sapiens
  misc_feature: GZ8MTXP02JEL6Y.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggagctgagcagtcagagatctgaggacatagatgtgtactactgtgcgagaccggtagaggacaagcaagaaaagagttctttagactactgggaccagggaaccctggtcaccgtctcctcacgcctccacaacgggcccacgtcggtccttcccccgtggcccacccgtcctaccaacgacgccaccgtcgtcgggggccacgacgccggcccgtgggccg

SEQ ID NO: 438571 - DNA, 490 bp, Homo sapiens
  misc_feature: GZ8MTXP02IFQCQ.44.36.D03.1.454.CMB.2.raw
  modified_base (245)..(245): a, c, t, g, unknown or other
  modified_base (304)..(304): a, c, t, g, unknown or other
  modified_base (406)..(406): a, c, t, g, unknown or other
  modified_base (480)..(480): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagtttgggctgagctgggtttcctcgttgctcttttaagaggtgtccagtgtcaggtgcagctggtggagtcgtgggggagcgtggtccagcctgggagtcccngagctctcctgtgcagcgtctggattcaccttcagtacctatggcatgcactgggtccncaggctccaggcaaggggctgggagtggggtggcacgttatagtggtatgatgggaaagtaataaatactatgcagactccgtgaaggccgattcaccatcncagagacaattccaagaacacgctgtatctgcaaatcgaacacgctgacgagccgagactagctgtgtattacngtcgcgagac

SEQ ID NO: 438572 - DNA, 548 bp, Homo sapiens
  misc_feature: GZ8MTXP02JBTOI.44.36.D03.1.454.CMB.2.raw
  modified_base (307)..(307): a, c, t, g, unknown or other
  modified_base (342)..(342): a, c, t, g, unknown or other
  modified_base (368)..(368): a, c, t, g, unknown or other
  modified_base (383)..(383): a, c, t, g, unknown or other
  modified_base (410)..(410): a, c, t, g, unknown or other
  modified_base (481)..(481): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctggagggtccctgagactctcctgtgtcgcctctggattcaccatcagtgaccactatatggactgggtccncagactccgagggaagggctggagtggcttggccncaagtaaaaacaagtgccagctttancacagagtacgccgngtctgtagaaagccagattccaccctnacaaatgatgacttcaaagaactcaatttgaatttcagacgtaaatgaaacctaaaccgtgaaaaacccgnggaccacggggcaaattgtaacttagttgtagtttgtgttttaaacatcgaaggtaactggtacccg

SEQ ID NO: 438573 - DNA, 527 bp, Homo sapiens
  misc_feature: GZ8MTXP02G26MA.44.36.D03.1.454.CMB.2.raw
  modified_base (308)..(308): a, c, t, g, unknown or other
  modified_base (369)..(369): a, c, t, g, unknown or other
  modified_base (416)..(416): a, c, t, g, unknown or other
  modified_base (423)..(423): a, c, t, g, unknown or other
  modified_base (440)..(440): a, c, t, g, unknown or other
  modified_base (450)..(450): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccnccaggctccgagggagggctggagtggctggccgacaagtaaaacagttgccagtctttancaacagtagtaccgccgacgtctgtagaaacgccagacttcaccctnacaaganatgacttcaaagaactnattgattcgngacgaatgaacctaacgtagaaaaccgaggacagggacagtgtattatgtgttgtgtttatatcaaggtctgtaccg

SEQ ID NO: 438574 - DNA, 548 bp, Homo sapiens
  misc_feature: GZ8MTXP02G358A.44.36.D03.1.454.CMB.2.raw
  modified_base (324)..(324): a, c, t, g, unknown or other
  modified_base (356)..(356): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctaccaaggacacctaccaaaaggcaggtgtctttagtatgaccaanatcgaccctgcggacaccaggcacatattacngtgcacgggtaatgacgggaaaagaaacagcttggtttctagtattataagttcttaccattacgtggtacgtcgtaggggacaaagggacacggtcaccgtctcctcgacgctaccaccgaacggccacgtcgtccttcccctcggccgccctcgacctccgagcgccaccgtcgcggggcacgagcccgg

SEQ ID NO: 438575 - DNA, 547 bp, Homo sapiens
  misc_feature: GZ8MTXP02G8P1L.44.36.D03.1.454.CMB.2.raw
  modified_base (222)..(222): a, c, t, g, unknown or other
  modified_base (306)..(306): a, c, t, g, unknown or other
  modified_base (364)..(364): a, c, t, g, unknown or other
  modified_base (367)..(367): a, c, t, g, unknown or other
  modified_base (403)..(403): a, c, t, g, unknown or other
  modified_base (410)..(410): a, c, t, g, unknown or other
  modified_base (430)..(430): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggagggtccctgagactctcctgtgtcgcctctggattcaccatcagtgaccatatatggactgggtccncaggctccgagggagggctggagtggctggccacaagtaaaacaagtgccagctttancanagagtacgcgcgtctgagaacgcagtactccacctnacaaganatcgtaactacaaagtactntattgacttcgagacgtaagtacgaaacctaaaccgacggaaaaccgacggaacgacggactagttagttaattagttgttagttaagttagtttactagtacgagtactcgtaccg

SEQ ID NO: 438576 - DNA, 590 bp, Homo sapiens
  misc_feature: GZ8MTXP02JJCD4.44.36.D03.1.454.CMB.2.raw
  modified_base (344)..(344): a, c, t, g, unknown or other
  modified_base (375)..(375): a, c, t, g, unknown or other
  modified_base (395)..(395): a, c, t, g, unknown or other
  modified_base (404)..(404): a, c, t, g, unknown or other
  modified_base (423)..(423): a, c, t, g, unknown or other
  modified_base (431)..(431): a, c, t, g, unknown or other
  modified_base (451)..(451): a, c, t, g, unknown or other
  modified_base (500)..(500): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggtccgccaggctccgaggggaaggggctgggagtgggcttgggccganaaggtaaaaacaaggttcgaccagtctttancacagagtaccgccgcgtcngtagaaacnccaagacttcccacccttnacgaaganatacgtactacaaagtactntattagtacttcgagacgtaatacgaaacctaaaccgaacgaaaaccgnggacgacggataagtgttattagttgttcgtttagttacgtttaatagtaacgaaggtaacttcgaccgtacggtcggggactaaacggg

SEQ ID NO: 438577 - DNA, 523 bp, Homo sapiens
  misc_feature: GZ8MTXP02JY9LE.44.36.D03.1.454.CMB.2.raw
  modified_base (369)..(369): a, c, t, g, unknown or other
  modified_base (437)..(437): a, c, t, g, unknown or other
  modified_base (446)..(446): a, c, t, g, unknown or other
  modified_base (472)..(472): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgagggaggggctggagtggcttggccgcaagtaaaacaagttgccagctttncacagagtacgccgcgtctgtagaaagcccagacttccaccctctcaagagatgacttcaaagaactnattgattcngacgaatgaactaacctgaaaaccgnggacacgggcatgtattattgtgttgtgtttatatcgaggtaactgtaccg

SEQ ID NO: 438578 - DNA, 596 bp, Homo sapiens
  misc_feature: GZ8MTXP02I21TA.44.36.D03.1.454.CMB.2.raw
  modified_base (221)..(221): a, c, t, g, unknown or other
  modified_base (374)..(374): a, c, t, g, unknown or other
  modified_base (395)..(395): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaaggtgtccagagtgaagtgcagttggtggagtccggggganacttggtccagcctggagggtccctgagactctcctgtgtcgcctctggattcaccatcagtgaccactatatggactgggtccgcaggctccgaggggagggctggagtgcgtggccgacgaaacgtaaaaacaagttcgaccagtctttancacgagacgtaccgcgcgtcngtagaaacgccaagtctccacccttcacaaggatatcgaacttacaaagtaaccttntagttagtacttcgtagaactaagtacgtaaaccgtaaaccgtaaacggaaaacccggacggaaccgacgggtactaagttacgttagtttacgtttggttagtttgttacgtttaatacgtacggtaacggtacgtacgtacg

SEQ ID NO: 438579 - DNA, 557 bp, Homo sapiens
  misc_feature: GZ8MTXP02IBR0V.44.36.D03.1.454.CMB.2.raw
  modified_base (392)..(392): a, c, t, g, unknown or other
  modified_base (427)..(427): a, c, t, g, unknown or other
  modified_base (442)..(442): a, c, t, g, unknown or other
  modified_base (470)..(470): a, c, t, g, unknown or other
  modified_base (513)..(513): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtggtttctgttgttatttacaaggtgtcagagtgaagtgcagttgggtggagtccgggggagacttggtccagcctgggagggtccctgagactctcctgtgtcgcctctggattcacatcagtgacactatatggactgggtccgccagggcctccgaggggaaggggctgggagtgggcgttgggccgacaagtaaaaacaaagttcgaccagctttatcacagagtacgcgcgtctgngaaagccagatcacctcacagagatgacttcgaanactctattgatttcngacgaaatgaaactaactaggaaaacgngacaggggactagtagttattagttgtgtttcgagtttttaanacgtaacgtaagtactcgaccgtacggtacgggtaccgaacggg

SEQ ID NO: 438580 - DNA, 555 bp, Homo sapiens
  misc_feature: GZ8MTXP02G9ICL.44.36.D03.1.454.CMB.2.raw
  modified_base (310)..(310): a, c, t, g, unknown or other
  modified_base (346)..(346): a, c, t, g, unknown or other
  modified_base (373)..(373): a, c, t, g, unknown or other
  modified_base (420)..(420): a, c, t, g, unknown or other
  modified_base (489)..(489): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtcgaccactatatggactgggtccncaggctccgaggggaggggctggagtggcttggccncaagtaaaaacagttgaccagctttancacagagtaccgcgcgtctgtagaaacgccaagtacttccacccctntacaaagagatgaacttcaaagactcaattgattctgacgaatcgaacttaaaccgagaaaaacccggnggaaccacggggctagtgttaattagttgttagttgttgtttaactatcgaggtaacttgtacccg

SEQ ID NO: 438581 - DNA, 563 bp, Homo sapiens
  misc_feature: GZ8MTXP02I5HVN.44.36.D03.1.454.CMB.2.raw
  modified_base (318)..(318): a, c, t, g, unknown or other
  modified_base (423)..(423): a, c, t, g, unknown or other
  modified_base (435)..(435): a, c, t, g, unknown or other
  modified_base (455)..(455): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgngggaagggctggagtggcttggccgacaagtaaaaacaagttgccagcttatcacagagtacgccgcgtctgtagaaagcccaagacttccaccctctacaaagngatgaaccttanaaagaactcattagattcgngacgaatacgaactaaaccgaacgaaaaccggacggaacgacgggactaagttacgttaacttagttgttgttaagttagtttaatactagtacggtaactcgtaccg

SEQ ID NO: 438582 - DNA, 574 bp, Homo sapiens
  misc_feature: GZ8MTXP02IHF9A.44.36.D03.1.454.CMB.2.raw
  modified_base (326)..(326): a, c, t, g, unknown or other
  modified_base (356)..(356): a, c, t, g, unknown or other
  modified_base (383)..(383): a, c, t, g, unknown or other
  modified_base (412)..(412): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctaccaaggacacctaccaaaaggcaggtgtactttagtatgaccaaanatgaccctgcggacaccagcacatattacngtgcacggtaatgacgggaaagaaacngcttgttctgtattataagttctacatcnggtacgtcgtggggacaaacgggacctacggtccaccgtctccgtacacgccttaccgaaccgtaacgggccccaacgttcccggtccctttcccccgcgtcccggccccttcgcctcccgaggaacgccacccgttcggacgggggccaccgacggcccgg

SEQ ID NO: 438583 - DNA, 564 bp, Homo sapiens
  misc_feature: GZ8MTXP02GXXXX.44.36.D03.1.454.CMB.2.raw
  modified_base (217)..(217): a, c, t, g, unknown or other
  modified_base (302)..(302): a, c, t, g, unknown or other
  modified_base (374)..(374): a, c, t, g, unknown or other
  modified_base (444)..(444): a, c, t, g, unknown or other
  modified_base (454)..(454): a, c, t, g, unknown or other
  modified_base (481)..(481): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggccagcctgggagggtccctgagactctcctgtgtcgcctctggattcaccatcagtgaccactatatggactgggtccnccagggctccgaggggaaggggctgggagtgggcttgggccgacaagtaaaaacaagttcgaccagctttancacagagtacgcgcgtctgtagaaacgccagacttccaccctctacaaagagatgacttacaaagacctnattgatttcngacgaatgaactaacctagaaaaccgnggaacacggggactagtagtattagttgtgtttagttagtttactatcgaaggtaactgtaccacggtcggggaccaacgggg

SEQ ID NO: 438584 - DNA, 560 bp, Homo sapiens
  misc_feature: GZ8MTXP02JPQK5.44.36.D03.1.454.CMB.2.raw
  modified_base (301)..(301): a, c, t, g, unknown or other
  modified_base (367)..(367): a, c, t, g, unknown or other
  modified_base (370)..(370): a, c, t, g, unknown or other
  modified_base (373)..(373): a, c, t, g, unknown or other
  modified_base (383)..(383): a, c, t, g, unknown or other
  modified_base (419)..(419): a, c, t, g, unknown or other
  modified_base (441)..(441): a, c, t, g, unknown or other
  modified_base (522)..(522): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatcagtgaccactatatggactgggtccnccaggctccgaggggaaggggctgggagtgggcttggccgcaagtaaaacaagttgccagctttancanagngtcgcgcgtntgtagaaacgcagtacttaccaccctctacaaaganatgaacttacaaagtaacctanattagtacttcgtagacgaatcgaaacctaacgtaagaaaaccgaggacgacggctagtgtattagtgtgttgttgtttanatgaaggtactcgacccgacggtcggggacctaacggg

SEQ ID NO: 438585 - DNA, 588 bp, Homo sapiens
  misc_feature: GZ8MTXP02JFMC7.44.36.D03.1.454.CMB.2.raw
  modified_base (370)..(370): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaaggtgtccagagtgaagtgcagttggtggagtccgggggagacttggtccagcctggaggtccctgagctctcctgtgtcgcctctggattcaccatcagtcgaccactatatggactgggtccgcaggctccgaggggagggctggagtggcttggccgacaagtaaaaacaagttgccagctttancacagagtacgccgtcgtctgtgaaacgcccaagtacttccaccctctacaaagacgatgaaaccttcgaaagtaacttcaatttgaatttcgtagaaagaattagaaaccttaaacccgaaggaaaaaacccggngggaaacaccggggactaagttagttaatttaagttgttagttaagttacgttttaatactacgaaggttaactcgtacccg

SEQ ID NO: 438586 - DNA, 556 bp, Homo sapiens
  misc_feature: GZ8MTXP02IT616.44.36.D03.1.454.CMB.2.raw
  modified_base (331)..(331): a, c, t, g, unknown or other
  modified_base (362)..(362): a, c, t, g, unknown or other
  modified_base (382)..(382): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactatactgatgttagaaaatataaccttgtctctggtaccaagtatacccaggtaaaccccccaaatccttcttatgaagtcaataagcgccctcgggctatttcncatcgcttctcacggctcaagtctggcaacncggcctcgttgattaattcngccctcctgcctgacgacgacggccgactattattgctgctcatatgcggtacctagtacttagttgggtcttcgggcggacgggaccggtcgtcggaccgtccgtacggtcgacgacccgaacggtcctccgcccccgtcggacctacctccgttccgtcccctacccttccc

SEQ ID NO: 438587 - DNA, 594 bp, Homo sapiens
  misc_feature: GZ8MTXP02F9CLF.44.36.D03.1.454.CMB.2.raw
  modified_base (336)..(336): a, c, t, g, unknown or other
  modified_base (359)..(359): a, c, t, g, unknown or other
  modified_base (418)..(418): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattaccgtggtgggggcgacgccgttggaggtaaagtgtacagtggtaccagcagaagccaggccagacccctgtgctggtcatctattatgatgcggccgcctcagtgatccctgcgcgcttcccnccggctccaactcgtagggaacncgggccaccctgacccatcagcagggtcgagggccggggatggaggccgactattacgngtcagccgtggtagggacaggtagtaggtgagtcgacgttcccggtaggttacgttcgggcggggaacgggaccgaaggccgtacggtacccggttccgtacgggggtaccacggaccccgaaagggcccgtaccggtccccccgtcgggttacccaccggtttccctttccccgg

SEQ ID NO: 438588 - DNA, 575 bp, Homo sapiens
  misc_feature: GZ8MTXP02G8JZC.44.36.D03.1.454.CMB.2.raw
  modified_base (310)..(310): a, c, t, g, unknown or other
  modified_base (381)..(381): a, c, t, g, unknown or other
  modified_base (430)..(430): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctctggattcaccatcagtgaccactatatggactgggtccnccaggctccgaggggaggggctgggagtggcgttggccgacgaagtaaaaacaagttcgaccagtctttancaacagagtaccgccgcgtctgtagaaacgccaagtacttccacccttnacaagagatgacttcaaagactcattgattcngacgaaatcgaacctaaaccgtagaaaacccggaggaccgacgggctaagttaggttactttagtttggttagtttgttagttttaatagttacgaaggtacctcggtacccg

SEQ ID NO: 438589 - DNA, 551 bp, Homo sapiens
  misc_feature: GZ8MTXP02IFK3V.44.36.D03.1.454.CMB.2.raw
  modified_base (210)..(210): a, c, t, g, unknown or other
  modified_base (224)..(224): a, c, t, g, unknown or other
  modified_base (270)..(270): a, c, t, g, unknown or other
  modified_base (331)..(331): a, c, t, g, unknown or other
  modified_base (373)..(373): a, c, t, g, unknown or other
  modified_base (528)..(528): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaaggtgtccagagtgaagtgcaggttggnggagtccggggganacttggtccagcctggagggtccctgagactctcctgtgtcgctcnggattcacatcagtgaccactatatggactgggtcccgcaggctccgaggggagggctggngtggcttggccgcaaagtaaaaacaagttgaccagtctttancaagagagtaccgccgcgtctgtagaaacgccaagacttcccacccttctacaaagagatgaacctttacaaaagtacttcatttgaattcgtgacgaaatgaaccttaaacagaaaacccgaggacgacgggcagtgtattagttgttagtgtntttatactcgagtaactgtaccg

SEQ ID NO: 438590 - DNA, 563 bp, Homo sapiens
  misc_feature: GZ8MTXP02GY0U6.44.36.D03.1.454.CMB.2.raw
  modified_base (307)..(307): a, c, t, g, unknown or other
  modified_base (368)..(368): a, c, t, g, unknown or other
  modified_base (371)..(371): a, c, t, g, unknown or other
  modified_base (382)..(382): a, c, t, g, unknown or other
  modified_base (416)..(416): a, c, t, g, unknown or other
  modified_base (434)..(434): a, c, t, g, unknown or other
  modified_base (439)..(439): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccncaggctccgagggaagggctggagtggcttggccgcaagtaaaaacaagtgccagctttancanagagtacgcgntctgagaaacgcagtactccaccctcacaaaganatagactacaaagaactnattanattcagactaatacgaaacctaaaccgtaacgaaaaccggacggaaccgacgggactaagttacgttaattacgttggttagtttaagttagtttaactatacgtaacggtaacgttcgtaccg

SEQ ID NO: 438591 - DNA, 580 bp, Homo sapiens
  misc_feature: GZ8MTXP02IK5HX.44.36.D03.1.454.CMB.2.raw
  modified_base (307)..(307): a, c, t, g, unknown or other
  modified_base (378)..(378): a, c, t, g, unknown or other
  modified_base (434)..(434): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccnccaggctccgagggaggggctgggagtggcttggccgacaaagtaaaaaccaagttgacctagtcctttancaacaggacgtaccgccgcgtctgtgaaagcccaagattcccaccctctacaaagngatagacttacaagaaacttcaattgattctagacgaatgaacctaaccgtagaaaaacccgaggaaaccacggggtacaagttacgttaatttaacgttggttagttaagttagtttattacgtagtaggtaaacttcgtacccg

SEQ ID NO: 438592 - DNA, 565 bp, Homo sapiens
  misc_feature: GZ8MTXP02JZGWL.44.36.D03.1.454.CMB.2.raw
  modified_base (375)..(375): a, c, t, g, unknown or other
  modified_base (494)..(494): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtccgccaggctccgaggggaaggggctgggagtggctggccgacaagtaaaacaagttcgccagtctttncacagagtacgccgcgtctgtagaaacgccaagacttcccaccctctacaaagagtatagacttacgaaagtactcattgattccagacgaatcgaacctaaccgtaagaaaaacccgnggaaccacggggactaagttagttaattagttggttgttgttagtttaatatacgacggtaactcgtaccg

SEQ ID NO: 438593 - DNA, 542 bp, Homo sapiens
  misc_feature: GZ8MTXP02IU98M.44.36.D03.1.454.CMB.2.raw
  modified_base (225)..(225): a, c, t, g, unknown or other
  modified_base (432)..(432): a, c, t, g, unknown or other
  modified_base (442)..(442): a, c, t, g, unknown or other
  modified_base (453)..(453): a, c, t, g, unknown or other
  modified_base (471)..(471): a, c, t, g, unknown or other
tcagacagtatatacacgaccggtgctcgatttagctgcgtcacgatctctcttgggggtgggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggancagatcccaacatcgggacagattctgatgtccactcggtaccaacacccttccaggaacacgcccccaaactcctcatctttggtaaacaactatccggccctgacggggtcccccctgacccgtattcctctcggcctccaaagttcctggccaccctcacgccctccctggcccatccacttggggcctccgaggcctagaagntggagggttnaatttattacngccctagtcctatgaacngcagccctgaggttgggttggtcgttcggcggacggaccaaggctggaccgtcgtggtccacgcccgaagg

SEQ ID NO: 438594 - DNA, 467 bp, Homo sapiens
  misc_feature: GZ8MTXP02JEWQT.44.36.D03.1.454.CMB.2.raw
  modified_base (460)..(467): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttatttctgtgcgaggcgagactggtctttcaatctatggggccgtggcaccctggtcactgtctcctcagcttccaccaagggcccatccggtcttccccctggccgcccctgcctccaggacgccacctcgtcgggggcacgacgccggcccgtggggcctggcctgggtccaagggacctacgttcctatatactgtctgaggcggggctgggcaagggcgacatagnnnnnnnn

SEQ ID NO: 438595 - DNA, 544 bp, Homo sapiens
  misc_feature: GZ8MTXP02HTMX8.44.36.D03.1.454.CMB.2.raw
  modified_base (370)..(370): a, c, t, g, unknown or other
  modified_base (385)..(385): a, c, t, g, unknown or other
  modified_base (480)..(480): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgagggaggggctggagtggctggccgcaagtaaaaacaagttgccagctttancacagagtacgccgngtctgtgaaagccaagacttcaccctctcaagagatgacttcaaagacttcattgatttcgtgacgtaatcgaactaaaccgtagaaaaacccgnggaacaccggggactagtgtattagttgtagttgttagtttaatatcgtaaggtactcgtaccg

SEQ ID NO: 438596 - DNA, 624 bp, Homo sapiens
  misc_feature: GZ8MTXP02H7J87.44.36.D03.1.454.CMB.2.raw
  modified_base (378)..(378): a, c, t, g, unknown or other
  modified_base (384)..(384): a, c, t, g, unknown or other
  modified_base (396)..(396): a, c, t, g, unknown or other
  modified_base (561)..(561): a, c, t, g, unknown or other
tcagacagtatatacacgaccggtgctcgatttagctgcgtcacgatctctcttgggggagagtggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggaggtccctgagactctcctgtgtcgcctctggattcaccatcagtgaccactatatggactcgggtccgccaggctccgaggggaaggggctgggagtgggcgttgggccgacgaagtaaaaacaagttcgaccagtctttancacagngtacgccgcgtntgtgaaacgccaagactccaaccctcacaagaagatagacttacaaagaactctaatttgaatttctagacgtaaagttgaaacctaaaccgtaacggaaaaacccgagggaacaacggggactaagttgttaatttagttggttagtttagttacgtttttaanacgtttaacgtaacggtaaaccttcggttacccgacggttacgggggacccgtaaaccggggg

SEQ ID NO: 438597 - DNA, 554 bp, Homo sapiens
  misc_feature: GZ8MTXP02HX3E3.44.36.D03.1.454.CMB.2.raw
  modified_base (223)..(223): a, c, t, g, unknown or other
  modified_base (295)..(295): a, c, t, g, unknown or other
  modified_base (307)..(307): a, c, t, g, unknown or other
  modified_base (344)..(344): a, c, t, g, unknown or other
  modified_base (372)..(372): a, c, t, g, unknown or other
  modified_base (390)..(390): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccatatanggactgggtccncaggctccgaggggaggggctgggagtggctggcccnaagtaaaaaccagttcgccagtctttancaacagacgttacgccgntctgtagaaagccagacttcaccctctacaagagatgactttacaaagtaactcaattgattctgacgtaatcgaactaaaccgtagaaaacccgaggaacgacggggacagttagtattattgtagtttgttgtttaatactacgtaaggtacttcgtacccg

SEQ ID NO: 438598 - DNA, 675 bp, Homo sapiens
  misc_feature: GZ8MTXP02H7MWF.44.36.D03.1.454.CMB.2.raw
  modified_base (326)..(326): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccgagggaaggccctggagtggcttgcacacatcttctcgaatgacgaaaatcctaacagtacatctctgaagagcaagtttaaccaatctaccaaggaccacctaccaaaaggcaggtgtctttagatgacaanatggaccctgcggacaccgagcacatattactgtgacgaacggtaatggaacggaaagaaacagaccgttggttactagttattaagaacgttcttaaccattacgtggaccgtgtacgggggacaaaacggggtacctacggttacgacccggttcctacccgttacaacggtcccttacccgaaaccgaaccgggggtcccctaacggttacccgggttaccccttttccccccgtcggacccccgtccccgtacggtacccttccccgaaacgggtaacccggtccccaaaccccggtttcgggtaccggggggccccctaaaaccggtccgggtcccccccgggg

SEQ ID NO: 438599 - DNA, 574 bp, Homo sapiens
  misc_feature: GZ8MTXP02GMBNT.44.36.D03.1.454.CMB.2.raw
  modified_base (365)..(365): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctgggacccccggcagagggtcatcatctcttgttctggaagcagttccaacatcggccctaattctgtatatggtaccagcaagtcccaggaccgcccccaaactcctcatctataggactaatcagcggccctcgaggggtccctgaccgattctcctggctccaagtctggcncctcacgcctccctggccatccagtcgggcccccggtcgacggacgaggttgacttactacgtgcgcaggtcgttggggatcggacccgtccgtggacgggcgttgggcgttggttcgggcgggaggggaacccaaaacgtcgaccgtccgtaggtccacggccccaaggcctccgccccctcggtccacgtccttcgtccccgtcccc

SEQ ID NO: 438600 - DNA, 783 bp, Homo sapiens
  misc_feature: GZ8MTXP02IHN3T.44.36.D03.1.454.CMB.2.raw
  modified_base (222)..(222): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccggggganacttggtccagcctggagggtccctgagactctcccgtgtcgtcctcctgtagtctcactatcagtacacctatatagcggtacgtcggccacgtacggtccacggggaaggggacgggtcgtagggtaggtcggtcgtcggggaccgtaaccgtaaaaaacggtaaaaacgtaagttcggacctaaggtttctttacgtaccaacgtaaggtaccgtacccgccggtacgttccgtagggtaaagaaccggtaccctagttaaccttacccctacccgttcctaaacgaaaggaacgtattccggttaaaaccgtttaaacgaaaaacttaacccgtttacgtaacgtttacgtaactttccggaacgtaaacgtaacgttaaacccgtaaaacccgttaaaaccggtaaaaccggggaaaacccggtaacgggtaaccggtaacgggtaaactttaaaggttaaacgttttacgttttaacggtttaggtttaggttttaagttttaaaccgtttaagttacggtaacggttaaacggttacgttacccggtaaccggg

SEQ ID NO: 438601 - DNA, 605 bp, Homo sapiens
  misc_feature: GZ8MTXP02F3Z33.44.36.D03.1.454.CMB.2.raw
  modified_base (217)..(217): a, c, t, g, unknown or other
  modified_base (302)..(302): a, c, t, g, unknown or other
  modified_base (367)..(367): a, c, t, g, unknown or other
  modified_base (383)..(383): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccnccaggctccgagggagggctggagtggcttgggccacaagtaaaaacaagttcgaccagctttancacagcgtcgcgcgtntgtagaaacgccagtacttccaccctctacaagagatacgaacttacaaacgtaactactattagtattcgtagacgtaaatacgtaaaccttaaaccgtaacggaaaaaccggagggaaccgaacgggactaagttagttaatttagttgttagtttagttagtttaatacgtaacgtaacggtaacttacggtaccgacggtacggggaccgtaacgggg

SEQ ID NO: 438602 - DNA, 543 bp, Homo sapiens
  misc_feature: GZ8MTXP02HYX4H.44.36.D03.1.454.CMB.2.raw
  modified_base (321)..(321): a, c, t, g, unknown or other
  modified_base (372)..(372): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctaccaagacacctcaaaaggcaggtgtacttagtatgaccaanatcgaccctgcgacacagcacatattactgtgcacggtaatgacgggaaanaacagcttgttctagtattataacgttacttacctaatctaggacgtcgtaggggacaaagggaccaggtccaccgtctctcagtcctccaccgaacgggcccagtccggtccttcccccgtgcccgccctcgcctccgacggcgcaccgtcgcggggccaacgcgcccgg

SEQ ID NO: 438603 - DNA, 560 bp, Homo sapiens
  misc_feature: GZ8MTXP02JG0CB.44.36.D03.1.454.CMB.2.raw
  modified_base (208)..(208): a, c, t, g, unknown or other
  modified_base (308)..(308): a, c, t, g, unknown or other
  modified_base (373)..(373): a, c, t, g, unknown or other
  modified_base (416)..(416): a, c, t, g, unknown or other
  modified_base (443)..(443): a, c, t, g, unknown or other
  modified_base (447)..(447): a, c, t, g, unknown or other
  modified_base (487)..(487): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggnggagtccgggcgagacttggtccagcctggagggtccctgagacctctcctgtgtcgcctctggattcaccatcagtgaccactatatggactgggtccncaggctccgaggggagggctggagtggcttggccccgcaagtaaaaacagttcgaccagctttancacagatacgcgcgtctgtagaaacgccagtacttccaccctntacaagcgatgacttacaaagaccttnattnattcgagacgtaatacgaacctaaacgaacgaaaaccggnggaccgacgggactaagttacgttaactttagttggttaagtttagttagtttatagtacgaacggtaactcg

SEQ ID NO: 438604 - DNA, 635 bp, Homo sapiens
  misc_feature: GZ8MTXP02JEWKV.44.36.D03.1.454.CMB.2.raw
  modified_base (217)..(217): a, c, t, g, unknown or other
  modified_base (303)..(303): a, c, t, g, unknown or other
  modified_base (374)..(374): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctcctgtgtcgcctctggattcaccatcagtgaccatatatggactggggtccnccaggctccgagggaaggggctgggagtggcttgggccgacgaagtaaaaacaagttgccagtctttaacncaacgagacgtaccgcgcgtgtagtacgaaacgccaagtacttcccaccctctacaaagagactacgtaacttaacgaaacgtaactactaatttgtaactttcgtaggtaacgtaaagtacgaaacccttaaaaccgtaaacggaaaaccggacggaaccgacggggactagttagttaatttagttaggttagtttagtttagtttaatacgtaacgaacggtaacttcggtaccgacggtcggggacccgtaaacggg

SEQ ID NO: 438605 - DNA, 513 bp, Homo sapiens
  misc_feature: GZ8MTXP02F9NLG.44.36.D03.1.454.CMB.2.raw
  modified_base (356)..(356): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgaccttctatgtcctgactcagccaccctcagtctcagtggccccaggggagacggccaggattaccgtggtgggggcgacgccgttggaggtaaagtgtacagtggtacagcagaagccaggccagacccctgtgctggtcatctattatgatgcggccgcctcagtgactccctgcgcgcttccgtccgctccaactctaggaacncggccaccctgaccatcagcagggtcgaggccgggatggagccgatatactgtacagcgtgtggacagtagtagtgatcatccgtgtagtcggcggacggacagctcgaccgtcgtcggtcacgcccgaaggcctcgccccgtcggtcactctcccg

SEQ ID NO: 438606 - DNA, 555 bp, Homo sapiens
  misc_feature: GZ8MTXP02HAH0F.44.36.D03.1.454.CMB.2.raw
  modified_base (321)..(321): a, c, t, g, unknown or other
  modified_base (353)..(353): a, c, t, g, unknown or other
  modified_base (381)..(381): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaagacacctccaaaaggcaggtggtctttagtatgaccaanatggaccctgcggacaccaggcacatattacngtgcacgggtaatgacgggaaagaaacngactggttctgtattataagtcttaccatcgtggacgtcgtaggggacaaagggccacggtcaccggtctccgtcacgtcttccaccgaacgggcccacgtccggtccttcccccgcggccgcccgtcgcctccgaggaacgccacccgtcgtcgggggccacgacggcccggg

SEQ ID NO: 438607 - DNA, 544 bp, Homo sapiens
  misc_feature: GZ8MTXP02G2GY1.44.36.D03.1.454.CMB.2.raw
  modified_base (304)..(304): a, c, t, g, unknown or other
  modified_base (340)..(340): a, c, t, g, unknown or other
  modified_base (368)..(368): a, c, t, g, unknown or other
  modified_base (371)..(371): a, c, t, g, unknown or other
  modified_base (383)..(383): a, c, t, g, unknown or other
  modified_base (436)..(436): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaaggtgtccagagtgaagtgcagttggtggagtccgggggagacttggtccagcctggagggtccctgagactctcctgtgtcgcctctggattcaccatcagtgaccatatatggactgggccncaggctccgaggggagggctggagtggcttgggccncgaagtaaaaacagttcgccagctttancanagagtacgccgngtctgtagaaagtcagattccaccctctacaagagatgacttcaaagtacctnattagattcgagacgtaatcgaacctaacgagaaaacgnggacgacggactagtgtattagttggtgttaagttactttaatacgtacgtaacggtacttcggtaccg

SEQ ID NO: 438608 - DNA, 579 bp, Homo sapiens
  misc_feature: GZ8MTXP02GVY1K.44.36.D03.1.454.CMB.2.raw
  modified_base (222)..(222): a, c, t, g, unknown or other
  modified_base (368)..(368): a, c, t, g, unknown or other
  modified_base (425)..(425): a, c, t, g, unknown or other
  modified_base (447)..(447): a, c, t, g, unknown or other
  modified_base (460)..(460): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccggggganacttggtccagcctggagggtccctgagactctcctgtgtcgcctctggattcaccatcagtgaccatatatggactgggccgcaggctccgagggagggctggagtggcttggccgacaagtaaaaacaagttgaccagctttancacgagacgtaccgcgctcgtgagaaacgccaagtacttcccaccctctacaaaganatcgtaacttacaaagtaactnatttgaatttcgngacgtaatcgtaaacctaaccgtaaggaaaacccggacggaaccgacgggactagttagttaactttagttgtttagtttaagttagtttaatacttacggaacgtaactcggtacccg

SEQ ID NO: 438609 - DNA, 537 bp, Homo sapiens
  misc_feature: GZ8MTXP02J1BE4.44.36.D03.1.454.CMB.2.raw
  modified_base (310)..(310): a, c, t, g, unknown or other
  modified_base (350)..(350): a, c, t, g, unknown or other
  modified_base (469)..(469): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctgggtggagtcgtgggggaggcttgggtacaggcggggggggtccctgagactctcctgtgcagcctctggattcatcttcagtgactatgccatgaactgggtccncaggctccgagggagggctggagtggttcatatgttaatntgctggagataccactactacgcagtactcgtgtgaaacgggcccgtattccaaccctaagttccccgaaggggaccaatcggacctaaagactcgactgtatctagggaaatgaaacngcctagagacgacgaggacacggctcgtctacttcgtgttcgaggacgtagtccgggcctagtttcgg

SEQ ID NO: 438610 - DNA, 591 bp, Homo sapiens
  misc_feature: GZ8MTXP02GQF8Q.44.36.D03.1.454.CMB.2.raw
  modified_base (375)..(375): a, c, t, g, unknown or other
  modified_base (435)..(435): a, c, t, g, unknown or other
  modified_base (509)..(509): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggagggctgggagtggctggccgacgaagtaaaaacaagttgaccagtctttancacagacgtaccgccgcgtctgtagaaacgcccaagactttcccaccctctacaaagganatcgaaccttacgaaagtaacttcaatttgaatttcgtgacgtaatcgaaaccttaaaccgagaaaaaccccgngggaaccgacgggctaagttgttaacgtttagttgttggtttaagtttagtttaacttatcgaaggtaaccttggtaccccg

SEQ ID NO: 438611 - DNA, 578 bp, Homo sapiens
  misc_feature: GZ8MTXP02HZ1PU.44.36.D03.1.454.CMB.2.raw
  modified_base (375)..(375): a, c, t, g, unknown or other
  modified_base (390)..(390): a, c, t, g, unknown or other
  modified_base (419)..(419): a, c, t, g, unknown or other
  modified_base (461)..(461): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtccgccaggctccgaggggaggggctgggagtggcttggccgcaagtaaaaacaagttgccagtctttancacagagtacgccgntctgtagaaagccagacttccaacccctntacaaagacgatgactttcaaagtacttcaatttgatttcgngactaatacgtaacctaaacgtaacggaaaaccgcggaacgacgggactaagttagttaactttagtttgttagtttaagttacgtttaatacgtacgtaaacggtacttcgtaccg

SEQ ID NO: 438612 - DNA, 688 bp, Homo sapiens
  misc_feature: GZ8MTXP02JMBV8.44.36.D03.1.454.CMB.2.raw
  modified_base (306)..(306): a, c, t, g, unknown or other
  modified_base (367)..(367): a, c, t, g, unknown or other
  modified_base (419)..(419): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccatatatggactgggtccncaggctccgaggggagggctggagtggctggccgcaagtaaaaacaagttgccagctttancacagagtacgccgcgtctgtgaaaacgcccaagactttaccgaaccccctntaccaaaaggagtaacttggaaaccctttccgaaaaaggtaaacccctttcgtaagtttcggtaactttccgaaggaaccgtaaacgtacggtaaaacccttaaaacccgtaaacgggaaaaaaccccgggtacgggaaaaccggaaccggggtaacttaaaggtttaacggtttaacttttaacggtttaggtttaggtttaacggtttaagtttttaaaacgttaacgttaaccggtaaacgggttaaacctttcgggtttaccccg

SEQ ID NO: 438613 - DNA, 542 bp, Homo sapiens
  misc_feature: GZ8MTXP02FS0WL.44.36.D03.1.454.CMB.2.raw
  modified_base (222)..(222): a, c, t, g, unknown or other
  modified_base (380)..(380): a, c, t, g, unknown or other
  modified_base (432)..(432): a, c, t, g, unknown or other
  modified_base (440)..(440): a, c, t, g, unknown or other
  modified_base (471)..(471): a, c, t, g, unknown or other
  modified_base (495)..(495): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctgggagggtccctgagactctctgtgtcgcctctggattcaccatcagtcgaccactatatggactgggtcccgccaggctccgaggggaacggggctgggagtggcttggccgacaagtaaaaacaaagttgaccagtctttancacagagtaccgccgtcgtctagtagaaacgccaagtacttcccaacccctntacaaagngatcgacttacaaagtaactcatttgattcnggacatgaactaacagaaaaccgngacgaggcagtgtattatgtagttgtgtttacatcaggactgtaccg

SEQ ID NO: 438614 - DNA, 552 bp, Homo sapiens
  misc_feature: GZ8MTXP02HQXQ1.44.36.D03.1.454.CMB.2.raw
  modified_base (204)..(204): a, c, t, g, unknown or other
  modified_base (240)..(240): a, c, t, g, unknown or other
  modified_base (294)..(294): a, c, t, g, unknown or other
  modified_base (300)..(300): a, c, t, g, unknown or other
  modified_base (338)..(338): a, c, t, g, unknown or other
  modified_base (359)..(359): a, c, t, g, unknown or other
  modified_base (363)..(363): a, c, t, g, unknown or other
  modified_base (410)..(410): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggacccccggnagaggtcatcatctcttgttctggagcagttccaanatcgcctaattctgtatatggaccagcaagtcccaggaccgcccccaaatcctnatctanagactaatcagccgcctcgacgggtcccagaccattcnccgtggcctcaagtctggccncctnacgccctcctgccatcacgtcggcccgtcgagcgagttgatactacngcgcagtcttggatcgaccgcgtggaggtcgttggctcggttcggacggacggaacctaaaacgcggtaccgtacgtaggaccacgcccgaaagcccgtcgcccccgtacggtcccacgttcccgtccgtttcccccgcccc

SEQ ID NO: 438615 - DNA, 586 bp, Homo sapiens
  misc_feature: GZ8MTXP02JDVQF.44.36.D03.1.454.CMB.2.raw
  modified_base (224)..(224): a, c, t, g, unknown or other
  modified_base (309)..(309): a, c, t, g, unknown or other
  modified_base (344)..(344): a, c, t, g, unknown or other
  modified_base (371)..(371): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttgttattttacaaggtgtccagagtgaagtgcagttggtggagtccggggganacttggtccagcctgggagggtccctgagactctcctgtgtcgcctctggattcaccatcagtgaccatatatggactgggtccncaggctccgaggggagggctggagtggctggccanaagtaaaaacaagttgccagtctttancacgagacgtaccgcgtcgtcgtgtagaaacgcctaagtacttcccaccctcaacgaagagatacgtaacttacgaaagtactctaagtttgtaacttcgtagaacgtaaatacgaaacctaaacgtaacggaaaaacccggacggaaccgacgggactaagttagttactttagttggttagttgttagtttatactagacggtactcgtaccg

SEQ ID NO: 438616 - DNA, 554 bp, Homo sapiens
  misc_feature: GZ8MTXP02JZ6ID.44.36.D03.1.454.CMB.2.raw
  modified_base (309)..(309): a, c, t, g, unknown or other
  modified_base (373)..(373): a, c, t, g, unknown or other
  modified_base (452)..(452): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccncaggctccgaggggaggggctgggagtggcttgggccgcaagtaaaaacaagttgccagctttncacagagtacgcgcgtctgtgaaagcccaagtacttccaccctctacaaagagatgacttacaaagactcattgatttngacgaatcgaactaacgtagaaaaaccggnggaacgacgggctaagtgttaattagttggttgttaagttgtttaatacgttacgagggtaactcgtacccg

SEQ ID NO: 438617 - DNA, 552 bp, Homo sapiens
  misc_feature: GZ8MTXP02HKSZE.44.36.D03.1.454.CMB.2.raw
  modified_base (287)..(287): a, c, t, g, unknown or other
  modified_base (308)..(308): a, c, t, g, unknown or other
  modified_base (357)..(357): a, c, t, g, unknown or other
  modified_base (380)..(380): a, c, t, g, unknown or other
  modified_base (462)..(462): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttcctgttgctattttagaaggtgtccatgtgaggtgcggctggtggagtcgtgggggaggcttgggtacgagggcgggggggtccctggagactctcctgtgcagcctctggattcatcttcagtnactatgccatgaactggtccncaggctcgagggagggctggagtggttcatatgttaatattgctggganactaccacctactacgcagactngtagacgggcctattcacctattccgagggtacaatgacccaaagaaccttcacttagtatacgtaggaaaactggaaaccngtacgtaggaacgacggaacggaggaacctacggtcttacgtacttacgttcgtggtacgaagtacggacgtccggacttacggtttcgg

SEQ ID NO: 438618 - DNA, 514 bp, Homo sapiens
  misc_feature: GZ8MTXP02FTJXI.44.36.D03.1.454.CMB.2.raw
  modified_base (312)..(312): a, c, t, g, unknown or other
  modified_base (353)..(353): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattacctgtgggggcgacgccgttggaggtaaagtgtacagtggtaccagcagaagccaggccagacccctgtgctggtcatctatatgatgcggccggcctnagtgatccctgcgcgcttcctccggctccactctcgggacncggccaccctgaccatcagcagggtcgaggccgggatggagccgactatactgtcagcgtgtgggacagtagtagtgatcatccgtggtacttcgggcggagggaccaggctcgaccgtcgtgggtcacgcccgaaggctcgccccctcggtcactctccg

SEQ ID NO: 438619 - DNA, 532 bp, Homo sapiens
  misc_feature: GZ8MTXP02HPTJ7.44.36.D03.1.454.CMB.2.raw
  modified_base (417)..(417): a, c, t, g, unknown or other
  modified_base (442)..(442): a, c, t, g, unknown or other
  modified_base (451)..(451): a, c, t, g, unknown or other
  modified_base (475)..(475): a, c, t, g, unknown or other
tcagacagtatatacacgaccggtgctcgatttagctgcgtcacgatctctcttggggagctctgagagcgggagccccagccccagaattcccaggtgttttcatttggtgatcagcactgaacacagaggactcaccatggagttcgggctgagctgggttttccttgttgttatttacaaggtgtccagagtgaagtgcagttggtggagtccggggagacttggtccagcctggagggtccctgagactctcctgtgtcgcctctggattcaccatcagtgaccactatatggactgggtccgccaggctccgaggggaggggctggagtggcttgggccgacaagtaaaaacaagttcgccagtctttatcacagagtaccgcgcgtctgtagaaagccagacttcaccctntcaagagatgacttcaaagaacttnattgattcngacaatcgaactaacagaaaacgngacgaggcagtatacttgttgttgttgttagtttatactcgtaaggtacttcgaccg

SEQ ID NO: 438620 - DNA, 666 bp, Homo sapiens
  misc_feature: GZ8MTXP02IP854.44.36.D03.1.454.CMB.2.raw
  modified_base (271)..(271): a, c, t, g, unknown or other
  modified_base (432)..(432): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaagtgtccagagtgaagtgcagttggtggagtccgggggagacgttggtccagcctggagggtccctgagactctcctgtgtcgcctctgnttcaccatcagtgaccatatatggactgggtccgcaggctcgaggggagggctggagtggcgttggccgacgaaagtaaaaaactaagttcgacctaagtctttagtacaacagacgtaccgcgacgttctagtagaaacgccaagtacttccaacccttntacaaagacgtagtacgtactttacgaaagtaccttataatttcggaactttccgaggaacctaaagttacggtaaaacccttaaacccgtaaacggaaaaaacccccggtagggaaaacccggaacccggggtaactaaaggtttacggtttaaacttttaacgtttggtttaggtttaagttacgtttttaaattacgtaacgtaaccgggttaaaacttcggttaaacccg

SEQ ID NO: 438621 - DNA, 558 bp, Homo sapiens
  misc_feature: GZ8MTXP02IDPE1.44.36.D03.1.454.CMB.2.raw
  modified_base (308)..(308): a, c, t, g, unknown or other
  modified_base (370)..(370): a, c, t, g, unknown or other
  modified_base (373)..(373): a, c, t, g, unknown or other
  modified_base (386)..(386): a, c, t, g, unknown or other
  modified_base (419)..(419): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccnccaggctccgagggagggctggagtggcttggccgcaagtaaaaacaagtgaccagctttancanagacgtccgcgtntctagtagaacgcagtactccacctcacaaganatcgtacttacgaaacgtaactctattgtattcgagacgtaatacgaaacctaaaccgtaacgaaaaccgacggacgacggactagtagttattagttgttagtttaagttagtttatactacgtacggtactcgaccg

SEQ ID NO: 438622 - DNA, 551 bp, Homo sapiens
  misc_feature: GZ8MTXP02H7HD0.44.36.D03.1.454.CMB.2.raw
  modified_base (349)..(349): a, c, t, g, unknown or other
  modified_base (377)..(377): a, c, t, g, unknown or other
  modified_base (408)..(408): a, c, t, g, unknown or other
  modified_base (436)..(436): a, c, t, g, unknown or other
tcagacagtatatacacgaccggtgctcgatttagctgcgtcacgatctctcttgggggtgggcacaagaggcagcactcaggacaatctccagcatggcctggtctcctctcctcctcactctcctcgctcactgcacagggtcctgggcccactctgtgctgacgcagccgccctcagtgtcgtggggccccgggcaggagggtcaccatctcctgcacgtgggagcagactaccaacagtcgggacagattctgatgtccactggtaaccaacacctcaaggaaccacgacccccaaactcctacacttctttacgaaacactatccgccctcgacggggtccccncgaccgtatcctctcggctccaagttcncggccctacctcacgtccctccctggcctanccacgtcgggtcctccgaggctagaagntggaggttgtactttatacgtgacctagtcctagtcgacagcacgcctacgaggttgggttggtgtccgggacgacggaccagtcgtcgtaccggtccgtggccacgaccgacgg

SEQ ID NO: 438623 - DNA, 601 bp, Homo sapiens
  misc_feature: GZ8MTXP02ICJEY.44.36.D03.1.454.CMB.2.raw
  modified_base (314)..(314): a, c, t, g, unknown or other
  modified_base (356)..(356): a, c, t, g, unknown or other
  modified_base (383)..(383): a, c, t, g, unknown or other
  modified_base (433)..(433): a, c, t, g, unknown or other
  modified_base (460)..(460): a, c, t, g, unknown or other
  modified_base (472)..(472): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtccgggttttccttgttgttattttacaaggtgtccagagtgaagtgcaggttggtggaggtccgggggagacgttggtccagccgtgggagggtccctgagactctcctgtgtcgctctggatcaccatcagtgaccactatatggacgtgggtcccnccgaggctccgaggggaagggcgtggagtggcgttggccganaacgtaaaaacaagtgacagtctttancaacagacgtaccgccgtcgtactgagaaacgccaagtacttccaccctntacaagagatgacttacaaagtacctntattgtacttcngacgaatgaacctaaacgtacgaaaaccgaggacgacgggactaagttagttaacgtttagtttggttagtttacggtttaagttttaatacgtttacgaacggttaacttcggtaccctaaccggggg

SEQ ID NO: 438624 - DNA, 533 bp, Homo sapiens
  misc_feature: GZ8MTXP02F9ADF.44.36.D03.1.454.CMB.2.raw
  modified_base (269)..(269): a, c, t, g, unknown or other
  modified_base (351)..(351): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggtttcctgttgctatttagaaggtgtccactgtgaggtgcggctggtggagtcgtgggggaggcttgggtacaggcggggggggtccctggagactctcctgtgcagcctcnggattcatcttcagtgactatgccatgaactgggtccgccaggcctccgaggggagggctggagtgggttcatatgttaatnttgctgggagataccacctactacgcagactctgtaggaacgggcctaattcacctaaattcccgagggacaatcgaccaaagaacctcactagtatacgtaggaaatgaaacagcctagagacgacgaggacacggctgtacctacttcgtgttacgagtacacgtccgggcctagttcgg

SEQ ID NO: 438625 - DNA, 595 bp, Homo sapiens
  misc_feature: GZ8MTXP02J2FPQ.44.36.D03.1.454.CMB.2.raw
  modified_base (376)..(376): a, c, t, g, unknown or other
  modified_base (429)..(429): a, c, t, g, unknown or other
  modified_base (461)..(461): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatcagtgaccactatatggactgggtcccgcaggcctccgaggggaagggctgggagtggcttggccgacgaagtaaaaacaagttgccagtctttancacagacgtaccgcgtcgtctagtacgaaacgccaagtaccttacccaccctnacgaaagagtatacgtaacttacaaagtactntagttacgatttcgacggtaactaaagtacgaaacctaaaccgaaacggaaaacccggacggaaccgacgggactagttagttacttagtttggttagttgtttagttaactagtacgaacggtacctcgaccg

SEQ ID NO: 438626 - DNA, 557 bp, Homo sapiens
  misc_feature: GZ8MTXP02GVZV1.44.36.D03.1.454.CMB.2.raw
  modified_base (319)..(319): a, c, t, g, unknown or other
  modified_base (376)..(376): a, c, t, g, unknown or other
  modified_base (409)..(409): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaagacacctccaaaaggcaggtgtcttagtatgaccaanatggaccctgcggacaccaggcacatattactgtgcacgggtaatgacggggaaaanaaacagctggttctgtattataagtctacatcnggactgtgggcaaagggccacggtcaccgtctccgtcacgcttaccaccaacgggcccaacgtccggttcccttcccccgtcgggcccgccccgttcgcctcccgacggaacgccgaaccctcggtcgggggccacgacggccccggg

SEQ ID NO: 438627 - DNA, 610 bp, Homo sapiens
  misc_feature: GZ8MTXP02JV8W4.44.36.D03.1.454.CMB.2.raw
  modified_base (366)..(366): a, c, t, g, unknown or other
  modified_base (369)..(369): a, c, t, g, unknown or other
  modified_base (393)..(393): a, c, t, g, unknown or other
  modified_base (411)..(411): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccgccaggctccgagggagggctggagtggctggccgacagtaaaacaagtgccagctttancanagagtacgcgcgtctgtagaaacncaagtacttcccaccctnacgaaagagtatacgtaaccttacgaaaagtaccttactaagtttcgtaactttccgaggtaaccgtaaaatcggtaaaccttaaaacccgtaaaggaaaaaccccgggacggaaccgacggggtactaagttacgttaatttagtttggttacggtttgttagttttaacagttacgaaacggtaaccttggtacccg

SEQ ID NO: 438628 - DNA, 573 bp, Homo sapiens
  misc_feature: GZ8MTXP02FUZXO.44.36.D03.1.454.CMB.2.raw
  modified_base (344)..(344): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggacacctaccaaaaggcaggtgtcttagtatgaccaacatcggacctgcggacaccagcanatattactgtgcacgggtaatgacgggaaaagaaacagtcgttggtttactagttattaataagttcttacctatcgtggacgtcgtaggggacgtaaagggaccacggtcaccgtctccctcgacgccttccaccgtaacgggccccaagtcccggttccttcccccgtcggcccgtcccgtcgcctcccgaggaacgccaccgttcgcggggacacgacgccccggg

SEQ ID NO: 438629 - DNA, 590 bp, Homo sapiens
  misc_feature: GZ8MTXP02J0BHF.44.36.D03.1.454.CMB.2.raw
  modified_base (374)..(374): a, c, t, g, unknown or other
  modified_base (492)..(492): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggcctccgaggggaggggctgggagtgggcttgggccgacaagtaaaaacaagttcgaccagtctttancacagagtaccgccgcgtctgtagaaacgccaagtacttccacccctctacaaagagatgacttacaaagactcattgattctgacgtaaatcgaaccttaaaccgaggaaaaaccgnggaacgacgggactagtagtattagttagttggtttgttacgtttaattagtcgtaaagggtaaccttggtacccacggtcgggggaccctaacgggg

SEQ ID NO: 438630 - DNA, 571 bp, Homo sapiens
  misc_feature: GZ8MTXP02GLD5J.44.36.D03.1.454.CMB.2.raw
  modified_base (394)..(394): a, c, t, g, unknown or other
  modified_base (474)..(474): a, c, t, g, unknown or other
  modified_base (485)..(485): a, c, t, g, unknown or other
  modified_base (510)..(510): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctgggagggtccctgagactctcctgtgtcgcctctggattcaccatcagtcgacctactatatggactgggtcccgccaggcctccgaggggaaggggctgggaggtggtcgttcgggccgaccgaaagtaaaaacaaggttcacccagtctttancacagacgtaccgccgcgtctgtagaaaacgccaagtacttccaccctctacgaaagagatgaaccttacaaagtacctnattcgattccngacaatgaactaactagaaaaccgnggaacacgggcatgtattagttgttagttgttagtttactatcgacggtaactggtacccg

SEQ ID NO: 438631 - DNA, 553 bp, Homo sapiens
  misc_feature: GZ8MTXP02J3A34.44.36.D03.1.454.CMB.2.raw
  modified_base (270)..(270): a, c, t, g, unknown or other
  modified_base (374)..(374): a, c, t, g, unknown or other
  modified_base (389)..(389): a, c, t, g, unknown or other
  modified_base (393)..(393): a, c, t, g, unknown or other
  modified_base (417)..(417): a, c, t, g, unknown or other
  modified_base (424)..(424): a, c, t, g, unknown or other
  modified_base (426)..(426): a, c, t, g, unknown or other
  modified_base (431)..(431): a, c, t, g, unknown or other
  modified_base (438)..(438): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggacgggtccctgagactctcctgtgtcgcctntggattcaccatcagtgaccactatatggacctgggtcccgccaggcctcgaggggaggggctgggagtggctggccgcaagtaaaacaagttgccagctttancactagagtacgccngtcngtagaaagccagacttcacccctnacagagntnactanaatactntattgattcgagacaatcgaactaaccgaaggaaaaccgcggaacgacgggactagttagttaattagtttgttcgtttgttagtttaacacgttacgacggtactcggtacccg

SEQ ID NO: 438632 - DNA, 592 bp, Homo sapiens
  misc_feature: GZ8MTXP02F64L3.44.36.D03.1.454.CMB.2.raw
  modified_base (340)..(340): a, c, t, g, unknown or other
  modified_base (369)..(369): a, c, t, g, unknown or other
  modified_base (375)..(375): a, c, t, g, unknown or other
  modified_base (384)..(384): a, c, t, g, unknown or other
  modified_base (457)..(457): a, c, t, g, unknown or other
  modified_base (484)..(484): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccgcaggctccgaggggagggctggagtggcttggccganaagtaaaaacaagttcgaccagtctttancacagngtacgccgngtctgtagaaacgcccaagacttcccaccctctacaaagagatacgacttacaaagtactactattgtattcngacgaatcgaactaactagaaaaccgnggaaccgacgggactaagttggttaatttagtttggttagtttgttagtttaatataacgtaacggtaactcgggtaacctacgggtacggggtacccaaaccggggg

SEQ ID NO: 438633 - DNA, 553 bp, Homo sapiens
  misc_feature: GZ8MTXP02I5DYL.44.36.D03.1.454.CMB.2.raw
  modified_base (371)..(371): a, c, t, g, unknown or other
  modified_base (427)..(427): a, c, t, g, unknown or other
  modified_base (461)..(461): a, c, t, g, unknown or other
  modified_base (528)..(528): a, c, t, g, unknown or other
  modified_base (533)..(533): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggagggctggagtggctggccgacaagtaaaacaagttgaccagctttancacagacgtaccgcgcgtctgtagaaagcccaagactttcccaccctctacaaagngatcgaacttcaaagtaaccttctattgattcgngacgaatacgaactaaaccgtaagaaaacccggagacgacgggcaagttgtattattgtagtttgtntttanactcgaaggtactcgtaccg

SEQ ID NO: 438634 - DNA, 608 bp, Homo sapiens
  misc_feature: GZ8MTXP02HO9IB.44.36.D03.1.454.CMB.2.raw
  modified_base (253)..(253): a, c, t, g, unknown or other
  modified_base (335)..(335): a, c, t, g, unknown or other
  modified_base (363)..(363): a, c, t, g, unknown or other
  modified_base (390)..(390): a, c, t, g, unknown or other
  modified_base (396)..(396): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccaagggaacggccctggagtggcttgcacacatcttctcgaatgaacgaaaatcctaanagtacatctctagaagagacagtttaaaccatcctaccgaaggaccacctaccaaaaggcaggtgtactttagatgaacaanatcgacctgcgacaccagcacatatacngtgcgtaacggtaatggaacggaaaanaaacgngcttaggtttctagttaattagtaagttcttaaccagtctagggacgtcgtagggggacaaaggggacctaacggtccaaccggtccttaccgacgacgtccttacccgaacgaacggcccctaagtcccggttccctttcccccgcggtcccggtccctcggcccacccgagggaacccgccgaccgtcggacgggaccgacgacggccgg

SEQ ID NO: 438635 - DNA, 559 bp, Homo sapiens
  misc_feature: GZ8MTXP02I6A0J.44.36.D03.1.454.CMB.2.raw
  modified_base (248)..(248): a, c, t, g, unknown or other
  modified_base (348)..(348): a, c, t, g, unknown or other
  modified_base (355)..(355): a, c, t, g, unknown or other
  modified_base (509)..(509): a, c, t, g, unknown or other
  modified_base (514)..(514): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctanagtacatctctgaagagcagtttaaccatctaccaaggaccacctaccaaaaggcaggtgtactttagtatgaccaacatcggacctgcggacacagcanatatacngtgcagggtaatggacgggaaagaaacagtctggtttctagtattaattaagtacttaccattctggacgtcgtaggggacaaaggggaccacgggtaccaccggtctccgtcagtccttaccaccgaacggccctagtccggtccttccccgnggccnccctcgcctccgaaggcgccacgtccgaggggccacgcgcccggg

SEQ ID NO: 438636 - DNA, 519 bp, Homo sapiens
  misc_feature: GZ8MTXP02FQIN2.44.36.D03.1.454.CMB.2.raw
  modified_base (364)..(364): a, c, t, g, unknown or other
  modified_base (430)..(430): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttgggtacaggcggggggggtccctgagactctcctgtgcagcctctggattcatcttcagtgactatgccatgaactgggtccgccaggctccgaggggagggctggagtgggtttccagtatgttaatatgctggganataccacctactacgcagactctgtgaaggccgattcacctaatccagggacatgaccaaagactnactgtatctaggaatgaacagcctagagacgacgaggacgacggctacgtctacttcgtaagttcgagtacgacgtccggctacttcgg

SEQ ID NO: 438637 - DNA, 579 bp, Homo sapiens
  misc_feature: GZ8MTXP02GRRP8.44.36.D03.1.454.CMB.2.raw
  modified_base (374)..(374): a, c, t, g, unknown or other
  modified_base (419)..(419): a, c, t, g, unknown or other
  modified_base (444)..(444): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcctgttgttatttacaaggtgtccagagtgaagtgcagttggtggagtccgggggagacttggtccagcctggagggtccctgagactctcctgtgtcgcctctggattcaccatcagtgaccactatatggactgggtcccgccaggctccgaggggaggggctgggagtggcttggccgacaagtaaaaacaagttcgaccagctttancacagagtaccgccgcgtctgagaaacgccagacttccacccttnacaagagatgacttacaaagtactntattagattcgagacgtaatacgaacctaaaccgaacggaaaaccgaggaaccgacggactaagttacgtttaagttacgttggtttagtttaagtttagtttaacttacgtacgtaacggttaccgtacgtccg

SEQ ID NO: 438638 - DNA, 614 bp, Homo sapiens
  misc_feature: GZ8MTXP02IO4B7.44.36.D03.1.454.CMB.2.raw
  modified_base (271)..(271): a, c, t, g, unknown or other
  modified_base (311)..(311): a, c, t, g, unknown or other
  modified_base (374)..(374): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctcnggattcaccatcagtgaccactatatggactggggtcccnccaggctccgaggggaggggctggagtggctggccgcaagtaaaaacaagttgccagtctttncacagagtaccgcgngtctgtgaaagccagacttccaccctctacaagagatgaacttacaaagaacttcaatttgaatttctaggacgtaaatcgaaccttaaaaccgtaggaaaaaaccccggtaggaaaccgaacgggggacctaaagttacggttaaattttaacgtttggttaggttttaaggtttacgtttttaaagttactacgtaaacgggtaaacgtttcggttaaccccg

SEQ ID NO: 438639 - DNA, 642 bp, Homo sapiens
  misc_feature: GZ8MTXP02G8SRD.44.36.D03.1.454.CMB.2.raw
  modified_base (406)..(406): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggatacgttggtccaggcctggagggtccctgagctctcctgtgtcgctcgtgattcaccatcagtcgaccactatagtggacgtcgggtcccgccgaggcctccggaaggggaacggggcgtgggaggtcggcgttcgggccgacgaaaacgtaaaaacgaaggttcgacccgtagtcttttanaccgaacgaagtacgtaccgccgcgttcctagtacgaaacgcccaagtaccttcccaccctctacaagagtatcgacttacaaagacttctaattgtatttcgaggacctaatcgtaaacctaaaccgtaaacggaaaacccgtacggaccgacggggactaaagttcggttaatttagttggtttagtttaaggtttagttttactagtaccgtaaggtaaccttcggtaacccg

SEQ ID NO: 438640 - DNA, 555 bp, Homo sapiens
  misc_feature: GZ8MTXP02HGRKR.44.36.D03.1.454.CMB.2.raw
  modified_base (275)..(275): a, c, t, g, unknown or other
  modified_base (311)..(311): a, c, t, g, unknown or other
  modified_base (381)..(381): a, c, t, g, unknown or other
  modified_base (397)..(397): a, c, t, g, unknown or other
  modified_base (424)..(424): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacgttggtccagccgtggagggtccctgagactctcctgtgtcgcctctggnttcaccatcagtcgaccactatatggactgggtccnccgaggctccgagggagggctggagtgcgttggccgacaaagtaaaaacaagttgaccagtctttatcanagagtaccgcgcgtcngtagaaagccgaagtacttccaccctntacaaagagtatcgacttacaaagacttcaattgaatttcagacgtaatacgactaaaccgagaaaacccgagacacggctagtgttaattattgtgttaagttgttaactatagacgtaacttcgtaccg

SEQ ID NO: 438641 - DNA, 526 bp, Homo sapiens
  misc_feature: GZ8MTXP02FHDX1.44.36.D03.1.454.CMB.2.raw
  modified_base (373)..(373): a, c, t, g, unknown or other
  modified_base (415)..(415): a, c, t, g, unknown or other
  modified_base (423)..(423): a, c, t, g, unknown or other
  modified_base (476)..(476): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaaggggctgggagtggcttggccgcaagtaaaaacaagttgccagctttancaacagagtacgccgcgtctgtgaaagccagattccaccctntacaaagngatgaacttcaaagaactcattgattctgacaatgaactaactagaaaaccgnggacacgggcatgtattatgtagttgtgtttatactcaggaactgtaccg

SEQ ID NO: 438642 - DNA, 598 bp, Homo sapiens
  misc_feature: GZ8MTXP02JRWBM.44.36.D03.1.454.CMB.2.raw
  modified_base (301)..(301): a, c, t, g, unknown or other
  modified_base (326)..(326): a, c, t, g, unknown or other
tcagacagtatatacacgaccggtgctcgatttagctgcgtcacgatctctcttgggggggtcacaagaggcagcgctctcgggacgtctccaccatggcctgggctctgctcctcctcaccctcctcactcagggcacaggatcctgggctcagtctgccctggctcagcctccctccgtgtccggtctcctggacagtcagtcaccatctcctgcactggaaccacagtgacgtcggtcgtttgaccgtgtctcgtggtaccagcacgaccccagaacacgaccccaaatcattattangcgtcatcgttccgtcccttcggtntccctgacgcgtcttcctcgtggtccagtctggcacgcgcctcctgacctatctcgtcggcctccgaggcctggacggacgaggtctagtattactacgtgcagtcctactaattaactaaccgtaaaggttacggtaaacttacgttttaacgtagtttccgggacgacgtaacggggacccaaaggtccgtacggaacccgttccgtacgggtccaaccggccccgaaacgggtccctcccggccccccgtacggtcctaccgtttcccg

SEQ ID NO: 438643 - DNA, 720 bp, Homo sapiens
  misc_feature: GZ8MTXP02J0PLF.44.36.D03.1.454.CMB.2.raw
  modified_base (321)..(321): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctacgaatgaacgaaaatcctaacagtacatctctagaagagcagtttaaccatctcaagacacctacaaagcaggtgtcttagtatgaccaacntcgacctgcgacaccgagcacatatactgtgacgacgggtaataggacgggaaaagaaacagtccgttaggtttactaggttaatttaagtaaacgttacttaaccgtacttacgtacgggtaccgtacggttacgggggaaccgaaaacggggtacccgaccggttaccgaacccggttcctaccctccgtaaccgtacccgtttaaccccgaacccggtaaacccggggtaccccctaacggtttcccccggggtttacccccttacccccccggttacgggcccccgtaccccgttaccggccccgttaccccggaaaacggggtaacccgccccgtaacccggtttacccggggtccggggggaccctaacccgggaccgggttccccccggggg

SEQ ID NO: 438644 - DNA, 529 bp, Homo sapiens
  misc_feature: GZ8MTXP02GVTT0.44.36.D03.1.454.CMB.2.raw
  modified_base (353)..(353): a, c, t, g, unknown or other
  modified_base (362)..(362): a, c, t, g, unknown or other
  modified_base (497)..(497): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaaggtgtccactgtgaggtgcggctggtggagtcgtgggggaggcgttggtacgaggcgggggggtccctggagactctcctgtgcagcctctggattcatcttcagtgactatgccatgaactgggtccgccaggctccgagggagggctggagtgggttccatatgttaatnttgctgganataccacctactacgcagactctgtgaagggccgattcacctattccgagggacaatcgactaaagaactcactgtatcgtaggaaatgaaacagcctagagacgacgaggacacgggctcggtactacgtttcngttacgaagtagagtccgggcctacgtttcgg

SEQ ID NO: 438645 - DNA, 587 bp, Homo sapiens
  misc_feature: GZ8MTXP02F4QU0.44.36.D03.1.454.CMB.2.raw
  modified_base (203)..(203): a, c, t, g, unknown or other
  modified_base (300)..(300): a, c, t, g, unknown or other
  modified_base (370)..(370): a, c, t, g, unknown or other
  modified_base (492)..(492): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccgggggagacttggtccagcctggagggtccctgagactctcctgtgtcgctctggattcaccatcagtgaccatatatggactgggtccncaggctccgaggggaaggggctgggagtgggcttgggccgacaagtaaaaacaagttcgaccagctttancaacagacgtacgccgagtctgtagaaaacgcccaagtacttccaccctctacaaagacgatcgaacttacgaaagaactcaattgattctgacgaatcgaactaaacctaggaaaaaccgnggaaccacggggactaagtgtaattagttgttagttgttacgtttataagtcgaaggtaaactcgtaccgtacgtcgggggaccctaaacggggg

SEQ ID NO: 438646 - DNA, 584 bp, Homo sapiens
  misc_feature: GZ8MTXP02I15VA.44.36.D03.1.454.CMB.2.raw
  modified_base (209)..(209): a, c, t, g, unknown or other
  modified_base (224)..(224): a, c, t, g, unknown or other
  modified_base (317)..(317): a, c, t, g, unknown or other
  modified_base (385)..(385): a, c, t, g, unknown or other
  modified_base (403)..(403): a, c, t, g, unknown or other
  modified_base (436)..(436): a, c, t, g, unknown or other
  modified_base (469)..(469): a, c, t, g, unknown or other
  modified_base (561)..(561): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggaggtccggggganacgttggtccaggcctgggacgggtccctgagactctcctgtgtcgcctcgtggattcaccatcagtcgaccactatagtggactgggtcccnccagtcctaccgaggggaacgggctgggagtggctggccacaagtaaaaacagttcgacagtctttancacgagacgtaccgccgngtctagtagaaacgccagtacttcccacccttnacgaaagcgatcgtaacttacgaaagtaacctnaatttgactttcgagactaatcgaaacttaaaccgagaaaaacccgtggacccacgggctaaagtgttaacttagttgtagttgtagtttanactcgaacggtaactcgtacccg

SEQ ID NO: 438647 - DNA, 592 bp, Homo sapiens
  misc_feature: GZ8MTXP02GNM23.44.36.D03.1.454.CMB.2.raw
  modified_base (222)..(222): a, c, t, g, unknown or other
  modified_base (308)..(308): a, c, t, g, unknown or other
  modified_base (433)..(433): a, c, t, g, unknown or other
tcagacagtatatacacgaccggtgctcgatttagctgcgtcacgatctctcttgggtagctctgagagcggagccccagccccagaattcccaggtgttttcatttggtgatcagcactgaacacagaggactcaccatggagttcgggctgagctgggttttccttgttgttattttacaggtgtccagagtgaagtgcagttggtggagtccggggganacttggtccagcctggagggtccctgagctctcctgtgtcgcctctggattcaccatcagtgaccactatatggacgtgggtcccncaggcctccgaggggaaggggctgggagtggcgtggccgacaagtaaaaacaagttcgaccagtctttagcaacgagtacgtaccgccgtcgtctggtagaaacgcccaagacttccaccccctntacgaaagtagatcgaacttacaaagtacttcatttcgatttcgagacgtaatacgaaccttaaaccgaggaaaaaccccggaggaaaccgacggggactagttacggttaatttagttgttagttgttagtttactatcgaaggtaaccttgtacccg

SEQ ID NO: 438648 - DNA, 602 bp, Homo sapiens
  misc_feature: GZ8MTXP02GP2CJ.44.36.D03.1.454.CMB.2.raw
  modified_base (223)..(223): a, c, t, g, unknown or other
  modified_base (309)..(309): a, c, t, g, unknown or other
  modified_base (351)..(351): a, c, t, g, unknown or other
  modified_base (382)..(382): a, c, t, g, unknown or other
  modified_base (402)..(402): a, c, t, g, unknown or other
  modified_base (436)..(436): a, c, t, g, unknown or other
  modified_base (447)..(447): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctcctgtgtcgcctctggattcaccatcagtgaccatatatggactgggtcccncaggctccgaggggaaggggctgggagtggcttgggcccganaaagtaaaaacaagttcgacccagtctttancaactagacgtaccgcccgngtctgtagaaaagcccaaagacttcccacccctntaccaaagganatagaacctttacaaaaggtaacccttnaaatttggaatttccgagaccgtaaattggaaaccctaaaccgtagaaaaacccggaggaccaacggggcaataggttacttagttgttgttaacgttgttttaaacatcgtaaggtactcgtaccg

SEQ ID NO: 438649 - DNA, 540 bp, Homo sapiens
  misc_feature: GZ8MTXP02I3GNN.44.36.D03.1.454.CMB.2.raw
  modified_base (222)..(222): a, c, t, g, unknown or other
  modified_base (375)..(375): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttcctgttgttattttacaaggtgtccagagtgaagtgcagttggtggagtccggggganacttggtccagcctggagggtccctgagactctcctgtgtcgcctctggattcaccatcagtcgaccactatatggactgggtccgccaggctccgaggggaaggggctgggagtggcttggccgacagtaaaaacaagttcgaccagctttntcacagagtacgccgcgtctgtgaaagccagtacttcaccctctacaagagatgacttacaaagtactcattgattctgacgaatcgactaacctagaaaacccgaggacacgggctagtgtattagttgttagttgttgtttaactatcgaggtactgttaccg

SEQ ID NO: 438650 - DNA, 553 bp, Homo sapiens
  misc_feature: GZ8MTXP02IHZVG.44.36.D03.1.454.CMB.2.raw
  modified_base (307)..(307): a, c, t, g, unknown or other
  modified_base (422)..(422): a, c, t, g, unknown or other
  modified_base (453)..(453): a, c, t, g, unknown or other
  modified_base (484)..(484): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccnccaggctccgagggagggctggagtggctggccgacaagtaaaaacagttgacctagtctttatcaacagacgtaccgccgatctgtagaaagccagacttcaccctctacaagngatgacttacaaagtaactcattgatttcgngacaatcgaaacctaaccgtagaaaacccgngtacgacgggacagttgtaatttaacgttgttgtttgtgtttaatacttacgacggtaacttgtacccg

SEQ ID NO: 438651 - DNA, 575 bp, Homo sapiens
  misc_feature: GZ8MTXP02FRMC4.44.36.D03.1.454.CMB.2.raw
  modified_base (371)..(371): a, c, t, g, unknown or other
  modified_base (498)..(498): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccagggctccgaggggaggggctgggagtggcttgggccgacaagtaaaaacaagttcgccagctttancacagagtacgccgcgtctgtagaaacgccaagtacttccaccctctacaaagagatgaacttacaaagaacctctaattgaacttcgtgacgaaattcggaacctaaacccgtagaaaaacccggnggaaccgacggggcaagtgtattattgttgttgtgtttatatcgaaggaactcgtaccacgtcggggaccaacgggg

SEQ ID NO: 438652 - DNA, 592 bp, Homo sapiens
  misc_feature: GZ8MTXP02IDCCN.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatagaacgaaaatcctaacagtacatctctgaagagctaagtttaaccatctaccaaggaccacctaccaaaaggcaggtgtacttagtatgaaccaacatcggaccctgacggacaccagcacatattactgtgcgaggtaagtgacgggaaagaaacagtcttggttctagtattataagttacttaccatcgtaggtacgtcgtaggggacgaaagggacctacggtacctacccggtcctccgtactacgtccttacccaccgaacgggccctaacgtccggtcccttcccccgcgcccgtccctcgcctaccgaggaacgccgtaccgtcggtcgggggccacggcggccccggg

SEQ ID NO: 438653 - DNA, 596 bp, Homo sapiens
  misc_feature: GZ8MTXP02JV7CO.44.36.D03.1.454.CMB.2.raw
  modified_base (231)..(231): a, c, t, g, unknown or other
  modified_base (520)..(520): a, c, t, g, unknown or other
tcagacagtatatacacgaccggtgctcgatttagctgcgtcacgatctctcttgggggtgggcacaagaggcagcactcaggacaatctccagcatggcctggtctcctctcctcctcactctcctcgctcactgcacagggtcctgggcccactctgtgctgacgcagccgccctcagtgtcgtcgggggccccgggcaggagggtcaccgatctcctgcacgtgggancagactccaacagtcgggacagattctgatcgtacccacgtcggtaacccaactacccttaccgaaggaaccaccgaccccccaaatccctactaacttccgtttaggaaacctaactacgtccggcccctacggacggggtcccccctaggacccgtattcctcgtcggcctccgaagtctcggcctacccgtcacgtcccctcccgtcggcccatccacgtgggacctccgaggctagacgtatgggaggttatattacttacgtcggacctagttccctatcgacngcagccctagaggttggttcgggtcgttcggacgggtacggaccaggcgtacgaccgtcgtggcacgccgtaacgg

SEQ ID NO: 438654 - DNA, 512 bp, Homo sapiens
  misc_feature: GZ8MTXP02IDPOK.44.36.D03.1.454.CMB.2.raw
  modified_base (308)..(308): a, c, t, g, unknown or other
  modified_base (359)..(359): a, c, t, g, unknown or other
  modified_base (374)..(374): a, c, t, g, unknown or other
  modified_base (381)..(381): a, c, t, g, unknown or other
  modified_base (450)..(450): a, c, t, g, unknown or other
  modified_base (458)..(458): a, c, t, g, unknown or other
  modified_base (465)..(465): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcttgggtacgaggcgggggggtccctggagactctcctgtgcagcctctggattcatcttcagtgactatgccatgaactggtccncaggctccgagggagggctggagtggttccatatgttaatattgctggganataccactactacgnagacctngtgaaggccattcactaatccgagggacaatcgaccaaagaactcactgtaatcgtaggaaatgaaacngactaganacgacgngactcggctcgtacttctcgtgtacgagacgacgtcggactagtcgg

SEQ ID NO: 438655 - DNA, 648 bp, Homo sapiens
  misc_feature: GZ8MTXP02IQZPH.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacagtggagctgagcagtcagagatcgtgaggacatagatgtgtactacgtgtgcgagaccggtagagacaagacaaagaaaagaagtttacttttagacttaacgtaggggacccgtaacggggaaaccccttgggtaccgtaacccggttcccgtacccttaccgaccggaccccttacccaacccgaaacggggcccctaacggttccggttacccccgtttccccccgcgggtaccccacccccgtttaccctaaccccgtaacggtaaaccggccctaaaccccgtaaccggttccggggggaccctaaacccggacggacccccggggtaccccggttaccgggggtccccgg

SEQ ID NO: 438656 - DNA, 604 bp, Homo sapiens
  misc_feature: GZ8MTXP02JWKDU.44.36.D03.1.454.CMB.2.raw
  modified_base (308)..(308): a, c, t, g, unknown or other
  modified_base (342)..(342): a, c, t, g, unknown or other
  modified_base (369)..(369): a, c, t, g, unknown or other
  modified_base (372)..(372): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccatatatggactgggtccncaggctccgaggggagggctggagtggctggccncaagtaaaaacaagtgccagtctttancanagacgtaccgccgcgtctagtagaaacgccaagtacttacccaccctctaacgaaagagatacgtaaccttacgaaaacgtaactactaattgtaacttcgtagacgtaaatcgaaaccttaaacccgtaaaggaaaaacccggaggaaaccgacggggactaagttacgttaatttacgttggttagtttaagttaatttaacgtagtacgaacggtaacttcggtaaccg

SEQ ID NO: 438657 - DNA, 655 bp, Homo sapiens
  misc_feature: GZ8MTXP02HEWWA.44.36.D03.1.454.CMB.2.raw
  modified_base (351)..(351): a, c, t, g, unknown or other
  modified_base (380)..(380): a, c, t, g, unknown or other
  modified_base (542)..(542): a, c, t, g, unknown or other
  modified_base (604)..(604): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtgggagggtccctgagactctcctgtgtcgcctctggattcaccatcagtcgaccactatagtggactcgggtccgccaggcctccgaggggaggggctgggagtgggcttggccganaagtaaaaacaagttcgaccagtctttancaacagagtaccgccgtcgtctgtagaaacgcccaagacttcccaaccctctacaaagacgatacgtaaccttacaaaagtaaccttataattttaggaacttttccgaggtaccggtaaattaccggaaaccttaaaaccccgtaaggaaaaaaccccggngggaacccgtaacggggactaaagttagttaatttagttggttcgtttagttacgttttaanagttccgaaaggtaacttcgtcccgtacggtcgggggacctaaacccgggg

SEQ ID NO: 438658 - DNA, 626 bp, Homo sapiens
  misc_feature: GZ8MTXP02HIGUJ.44.36.D03.1.454.CMB.2.raw
  modified_base (222)..(222): a, c, t, g, unknown or other
  modified_base (307)..(307): a, c, t, g, unknown or other
  modified_base (366)..(366): a, c, t, g, unknown or other
  modified_base (414)..(414): a, c, t, g, unknown or other
  modified_base (447)..(447): a, c, t, g, unknown or other
  modified_base (511)..(511): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggagggtccctgagactctcctgtgtcgcctctggattcaccatcagtgaccactatatggactgggtccncaggctccgagggagggctggagtggctggccgcaagtaaaacagtcgccagtctttancaacagagtaccgccgcgtctgtagaaacgccaagtacttccaccctntacaaagagactgtaaccttacaaagtaccttnaagtttcgaatttccgtggacgtaaattcgaaccttaaaaccccgtaggaaaaaaacccccggnggaaacccgaccgggggtactaaacgttacggttaactttaacggtttggttaaggtttggtttagttttaaactacgttaccggtaaagggttaaacctttcggtaaaccccgg

SEQ ID NO: 438659 - DNA, 613 bp, Homo sapiens
  misc_feature: GZ8MTXP02JMR3V.44.36.D03.1.454.CMB.2.raw
  modified_base (219)..(219): a, c, t, g, unknown or other
  modified_base (304)..(304): a, c, t, g, unknown or other
  modified_base (369)..(369): a, c, t, g, unknown or other
  modified_base (418)..(418): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcctgtgttatttacaaggtgtccagagtgaagtgcagttggtggagtccggggganacttggtccagcctggagggtccctgagactctcctgtgtcgcctctggattcaccatcagtgaccactatatggactgggtccnccaggctccgagggaaggggctggagtggcttggccgtcagtaaaaacaagttgccagtctttancacagacgtacgcgtcgtcgtagagaaacgccaagtacttcccaccctnacgaaagacgtatacgtaaccttacgaaagtacttactagtttagtacttcgtagaaccgtaaataccgaaaccttaaaccgtaaacggaaaaacccggtacggaaccgtaacgggactaaagttacgttaactttacgttggttagtttaacgttagttttaactacgtacgtaaacggtaaccttcgtacccg

SEQ ID NO: 438660 - DNA, 634 bp, Homo sapiens
  misc_feature: GZ8MTXP02JZUCY.44.36.D03.1.454.CMB.2.raw
  modified_base (261)..(261): a, c, t, g, unknown or other
  modified_base (378)..(378): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcgtgtaggtatttacaaggtgtcagagtgaagtgcagtggtggagtcgggagatgtcgagcgtgaggtccgtgagactctcctgtgtcgcctcctggntcacactcagtacgacactatagtggacgtcggtccgccgacggcgtacggacgggagggacggtggaggtggtcgtcggcgaccgaaagtaaaacgtaaagtacgacacgtacttntacacagagtacgccgcgtcgtgtagaagacgacgtactacctaccctacctacaacgaagtagtacgtaacgtaactaacgtaactactattagttacgttacgtacgtacgtaacgtaacgtaaccgtaaaccgtaaaacgaaaaccggaaacggaacggaacgggaacgtaacgttacgttaagtttaacgtttaggtttaggtttaaggtttaggtttaagttacgttacgtaacggtaacgttacgtaccg

SEQ ID NO: 438661 - DNA, 582 bp, Homo sapiens
  misc_feature: GZ8MTXP02G5PT5.44.36.D03.1.454.CMB.2.raw
  modified_base (324)..(324): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatcctaccaagacacctaccaaaaggcaggtgtctttagtatgaccaanagtcggaccctgcggacaccagcacatatactgtgacacgggtaagtgacgggaaagaaacagctggtttctgtattataagtctaccatcgtaggtacgtcgtaggggacgaaagggccgacggtctaccggtcctaccgtctacgtccttaccgaccgacgggccctacgttcccggtcccttcccccgtcggcccgcccgtcggccctccgacggaacgcccgaccggttcggacggggccaacggcgtcccggg

SEQ ID NO: 438662 - DNA, 542 bp, Homo sapiens
  misc_feature: GZ8MTXP02FKTBL.44.36.D03.1.454.CMB.2.raw
  modified_base (316)..(316): a, c, t, g, unknown or other
  modified_base (394)..(394): a, c, t, g, unknown or other
  modified_base (480)..(480): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattacctgtgggggcgacgccgttggaggtaaagtgtacagtggtaccagcagaagccaggccagaccccctgtgctggtcatctttcaggataataagcggccctnagggatccctgagcgcttctctggctccaactctgggaaccacgggccactctgaccatcagcgcgacccacgcctcnggactgaggctgactattactgtcagacgtagggaagtgacgtaagttgggtgttcggcggagggaccgagcgtagtaccggttcncggtcacgcccgaacggccgtcgcccccgtcggtcctccgtcctcgttccccgcccttcccg

SEQ ID NO: 438663 - DNA, 547 bp, Homo sapiens
  misc_feature: GZ8MTXP02H0WKZ.44.36.D03.1.454.CMB.2.raw
  modified_base (305)..(305): a, c, t, g, unknown or other
  modified_base (343)..(343): a, c, t, g, unknown or other
  modified_base (371)..(371): a, c, t, g, unknown or other
  modified_base (419)..(419): a, c, t, g, unknown or other
  modified_base (453)..(453): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttatttaaaggtgtccagagtgaagtgcagttggtggagtccggggagacttggtccagcctggagggtccctgagactctcctgtgtcgcctctggattcaccatcagtgaccactatatggactggggtccnccaggctccgaggggagggctggagtggcttggccganaagtaaaaacaagttgaccagtctttancacagacgtacgccgcgtctgtagaaagcccaagtacttccacccttntacaagagatgacttacaagaactcattgattcngacgaatcgaactaaccgtagaaaaccgnggacacgggacagttgtaatttagttgttgttgttaagtttatatcaggtaacttcgtaccacgg

SEQ ID NO: 438664 - DNA, 700 bp, Homo sapiens
  misc_feature: GZ8MTXP02HS7AC.44.36.D03.1.454.CMB.2.raw
  modified_base (190)..(190): a, c, t, g, unknown or other
  modified_base (244)..(244): a, c, t, g, unknown or other
  modified_base (308)..(308): a, c, t, g, unknown or other
tcagacagtatatacacgaccggtgctcgatttagctgcgtcacgatctctcttgggggtcacaagaggcagcgctctcgggacgtctccaccatggcctggctctgctgctcctcactctcctgactcaggacacagggtacctgggcccagtctgccctagactcagccttgcctcgtgtctggttcncctggacagtcgatccaccatctcctgcacgttgggccagcaatgacattgganatactacctgtctctagtatcaaacacactcacggacaacgccccaaactcattacgttttagngttaccgagttgacgtccggtccgtacgtcgttcgtttactacgtcgtcttcttcgacggtccttacgaacgtctcggaccacgtcccggtccttaccgtcggtactactcccgttcgttcggggccttccggggaaaccttgggaaacgggacccgtagggtcccttaggaaccttttaacgtttaccgcgggtacccggtccttacgttaaccgtttaaacctccgttaacggtttgaaacgggtttaccggtttggggtttccggtttaaccggggccggtaaacgggttaccctcccggtaaccgtttccgaaacccggtttcccggtaaaacgggtacctaccccgggaccgtaaccggggtttcccttaccccggtttcccccggg

SEQ ID NO: 438665 - DNA, 589 bp, Homo sapiens
  misc_feature: GZ8MTXP02GH1VL.44.36.D03.1.454.CMB.2.raw
  modified_base (217)..(217): a, c, t, g, unknown or other
  modified_base (344)..(344): a, c, t, g, unknown or other
  modified_base (371)..(371): a, c, t, g, unknown or other
  modified_base (492)..(492): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagccgtggagggtccctgagactctcctgtgtcgcctctggattcaccatcagtgaccactatatggactgggtccgccaggctccgaggggaggggctgggagtggcttgggccganaagtaaaaacagttcgccagtctttancacagacgtacgccgcgtctgtagaaacgcccaagtacttcccaccctctacaaagagatgacttacaaagaactcattgattctagacgtaatcgaacctaaaccgtaggaaaaacccgnggaaccgacggggacagttggttaatttacgttgttacgtttgttacgttttatactcgaaggtaacttcggtaccacggtcggggacctaacgggg

SEQ ID NO: 438666 - DNA, 620 bp, Homo sapiens
  misc_feature: GZ8MTXP02HQXOY.44.36.D03.1.454.CMB.2.raw
  modified_base (325)..(325): a, c, t, g, unknown or other
  modified_base (393)..(393): a, c, t, g, unknown or other
  modified_base (415)..(415): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagtgcagttggtggaggtccgggggagtacgttggtccaggccgtgggacgggtccctgagtactctccgtgtcgtcgcctctggactcaccatcagtcgaccactatatggacgtcgggtcccncgaggctcggagggaggggctggagtggcgtggccgactaaagtaaaaacagttcgaccagtctttancacagacgtaccgccgtcgtcngtagaaacgccaagacttcccaccctctacaagatatagtaacttacgaaaacgtactctaattaggacttcgtagaccgtaatacgaaacctaaaccgtaaagaaaaacccggacggaaaccgacgggactaaggttagtaatttacgttgttaggtttaagtttacggttaactattacggtacggtaaacgttcgtacccgg

SEQ ID NO: 438667 - DNA, 555 bp, Homo sapiens
  misc_feature: GZ8MTXP02GOPG5.44.36.D03.1.454.CMB.2.raw
  modified_base (393)..(393): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggacacctccaaaaggcaggtgtctttagtatgaccaacatggaccctgcggacaccaggcacatattactgtgcgacgggtaatgacggggaaagaaacagctggtttcngtattataagtctactatcgtagacgtcgtggggacaaagggaccgacggtcaccgtctcctcacgtccttcaccaacgggcccagtccggtccttccccgcggtccgcccctcgccctcccgaggaacgccgaccgtcgtcgggggccacgacggcccggg

SEQ ID NO: 438668 - DNA, 546 bp, Homo sapiens
  misc_feature: GZ8MTXP02H71MX.44.36.D03.1.454.CMB.2.raw
  modified_base (299)..(299): a, c, t, g, unknown or other
  modified_base (371)..(371): a, c, t, g, unknown or other
  modified_base (423)..(423): a, c, t, g, unknown or other
  modified_base (473)..(473): a, c, t, g, unknown or other
tcagacagtatatacacgaccggtgctcgatttagctgcgtcacgatctctcttggggagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggagacttggtccagcctggagggtccctgagactctcctgtgtcgcctctggattcaccatcagtgaccactatatggactgggtccnccaggctccgaggggaaggggctgggagtgggcttggcccgacaaggtaaaaacaagttcgaccagctttancacagacgtacgccgacgtctgtagaaagcccagattccaccctctcaaagngatgacttcaaagactcattgattctgcgaatgaactaactgaaaaccgnggacacgggcaagtgtattattgtgttgtagtttactagtcaggaactcggcccacgtcggggcctaacgggg

SEQ ID NO: 438669 - DNA, 688 bp, Homo sapiens
  misc_feature: GZ8MTXP02FXC7Z.44.36.D03.1.454.CMB.2.raw
  modified_base (439)..(439): a, c, t, g, unknown or other
  modified_base (507)..(507): a, c, t, g, unknown or other
  modified_base (520)..(520): a, c, t, g, unknown or other
  modified_base (550)..(550): a, c, t, g, unknown or other
  modified_base (566)..(566): a, c, t, g, unknown or other
  modified_base (607)..(607): a, c, t, g, unknown or other
tcagacagtatatacacgaccggtgctcgatttagctgcgtcacgatctctcttggggagcctctgagagcggacgccccacgccccagaacttccccaggttgttttctatttggtgatcagcactgaacacagagactcaccatggagttcgggctgagtcgttgggttttccttgtttgtttattttacgaaggtgtccagagtgaagtgcgtaggttggtggaggtccgggggagtacgttggtccagccgtgggacggtccctgagctctcctgtcgtcgcctgtgtattccaccatcagtcgacccactatagtggacgttcgggtcccgccgaggcctacccggaagggggaacggggtctggggtagttcgttcgttcgggccgtacgtaaaacgtaaaaaacgtaaagtttcgaccctagttacttttanaccaacgtagtacgtacccgccgcgttctagtaagaaaacgcccgtaaagtctttacccacccccttntaacgaaaggtanactcgtaaacctttacgaaaagtacccttntatttacgactttcgnggaactaattacgaaaccttaaaccgaaggaaaaacccggnggaaccgaggtactaagttagtttactttagttgtttagtttggtttacttaagtacgtacgtaaacgtacgtacgtaccg

SEQ ID NO: 438670 - DNA, 589 bp, Homo sapiens
  misc_feature: GZ8MTXP02FOADJ.44.36.D03.1.454.CMB.2.raw
  modified_base (371)..(371): a, c, t, g, unknown or other
  modified_base (429)..(429): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgcaggctccgaggggaggggctgggagtggcttggccgacagtaaaaacaagttgccagctttancacgagacgtacgcgcgtctagtagaaacgccaagtacttcccaccctctacaaaganatacgaacttacgaaacgtactctattagtatttcgagacgtaatacgaaacctaaaccgtaacggaaaacccggacggaccgacgggactagttacgttaatttagttgtttagttaagttagttttaatacgttacgaaacggtaccttcggtacccg

SEQ ID NO: 438671 - DNA, 557 bp, Homo sapiens
  misc_feature: GZ8MTXP02I9Q2V.44.36.D03.1.454.CMB.2.raw
  modified_base (374)..(374): a, c, t, g, unknown or other
  modified_base (449)..(449): a, c, t, g, unknown or other
  modified_base (461)..(461): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccgccaggctccgaggggaagggctggagtggctggccgcaagtaaaaacaagttcgccagtctttancacagagtacgccgcgtctgtagaaacgcccaagacttccacccctcacaaagagatgaacttcaaagaaccttnatttgatttcgngacgtaatcgaactaaccgagaaaacccgaggacgacgggcaagttgtaatttagttgttagttgttagtttatactgaaggtactacggtacccg

SEQ ID NO: 438672 - DNA, 583 bp, Homo sapiens
  misc_feature: GZ8MTXP02JMWT9.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaacccatctaccaaggacacctaccaaaaggcaggtggtctttagtatgaccaacatggaccctgcggacaccaggcacatattactgtgcagggtaatgacgggaaaagaaacgagcgtggtttctgtattataagtcttaccatctggacgtcgtaggggacaaagggaccgacggtcaccggtctccgtcaggtccttaccgaccgtaacgggccccaacgttcccgggtccttcccccgtcgggcccgtcccgttcgccgttacccgacggaacgccacccgttcggcgggggacaccgacggcccggg

SEQ ID NO: 438673 - DNA, 523 bp, Homo sapiens
  misc_feature: GZ8MTXP02GGO3I.44.36.D03.1.454.CMB.2.raw
  modified_base (366)..(366): a, c, t, g, unknown or other
  modified_base (454)..(454): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttgggtacgagggcgggggggtccctggagactctcctgtgcagcctctggattcatcttcagtgactatgccatgaacgtgggtccgccaggcctccgaggggaagggctggagtgggttcatatgttaatattgctgganataccacctactacgcagactctgtagaagggccattcacctatccgaggacatgacaaagactcactgtatcgtaggaaatgaaacngcctagaagacgacgagacacggctcgtactacttcgtgttacgagacgtacgtacgggcctagttcgg

SEQ ID NO: 438674 - DNA, 579 bp, Homo sapiens
  misc_feature: GZ8MTXP02FJT8E.44.36.D03.1.454.CMB.2.raw
  modified_base (269)..(269): a, c, t, g, unknown or other
  modified_base (308)..(308): a, c, t, g, unknown or other
  modified_base (372)..(372): a, c, t, g, unknown or other
  modified_base (495)..(495): a, c, t, g, unknown or other
  modified_base (551)..(551): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccgggggagacttggtccagcctggagggtccctgagactctcctgtgtcgcctntggattcaccatcagtgaccactatatggactgggtccncaggctccgagggaggggctgggagtggcttgggccacaagtaaaaacaagttgccagctttancacagagtaccgcgcgtctgtagaaacgccagacttccacccctctacaaagagatgaacttacaaagtaactcaattgaattcctagacgaatcgaacctaaaccgtaggaaaaaacccggnggaaccgacgggactagttagttaactttagttgtttagtttgtttacgttttaanacgttacgaacggtaaccgtcgtacccg

SEQ ID NO: 438675 - DNA, 572 bp, Homo sapiens
  misc_feature: GZ8MTXP02GAAT2.44.36.D03.1.454.CMB.2.raw
  modified_base (274)..(274): a, c, t, g, unknown or other
  modified_base (313)..(313): a, c, t, g, unknown or other
  modified_base (385)..(385): a, c, t, g, unknown or other
  modified_base (439)..(439): a, c, t, g, unknown or other
  modified_base (458)..(458): a, c, t, g, unknown or other
  modified_base (467)..(467): a, c, t, g, unknown or other
  modified_base (477)..(477): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccgggggagacttggtccagccgtgggacgggtccctggagactctcctgtgtcgcctnggattcaccatcagtcgaccatatagtggactgggtccncaggctcgaggggaggggctgggagtggcttcgggccgacgaaagtaaaaacgaagttcgaccagtctttancaacaggtacgtaccgccgcgttcgtgtagaaacgtccaagtacttccaccctntacgaaagatatgaacttnaaagtactntattgattcngacgtatacgactaactagaaaacgcgacgacggctagtacgttatttacgttgttagttgttagtttaactacgtacgtaaggtactcgtaccg

SEQ ID NO: 438676 - DNA, 551 bp, Homo sapiens
  misc_feature: GZ8MTXP02F5SKN.44.36.D03.1.454.CMB.2.raw
  modified_base (301)..(301): a, c, t, g, unknown or other
  modified_base (339)..(339): a, c, t, g, unknown or other
  modified_base (383)..(383): a, c, t, g, unknown or other
  modified_base (395)..(395): a, c, t, g, unknown or other
  modified_base (410)..(410): a, c, t, g, unknown or other
  modified_base (418)..(418): a, c, t, g, unknown or other
  modified_base (426)..(426): a, c, t, g, unknown or other
  modified_base (473)..(473): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccagcctggagggtccctgagactctcctgtgtcgcctctggattcaccatcagtgaccactatatggactgggtccnccaggctccgagggaagggctggagtggcttgggccgnaagtaaaaacaagttcgaccagtcttatcaacagagtacgccgngtctgtagaaanccagattccaccctntacaaganatgacttnaaagactacattgattctgacgtaatcgaactaacctagaaaaccgnggaacacgggacagttgtattattgtagttgtagtttatataacgaggtaaactcgtaccagtcgggggcctaacggg

SEQ ID NO: 438677 - DNA, 575 bp, Homo sapiens
  misc_feature: GZ8MTXP02JOYMV.44.36.D03.1.454.CMB.2.raw
  modified_base (307)..(307): a, c, t, g, unknown or other
  modified_base (360)..(360): a, c, t, g, unknown or other
  modified_base (374)..(374): a, c, t, g, unknown or other
  modified_base (386)..(386): a, c, t, g, unknown or other
  modified_base (445)..(445): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccncaggctccgaggggaagggctggagtggctggccgacaagtaaaaacaagttnccagctttagcaanaggatacgccgngtctgtagaaagccaagattccaccctctacaaagagatgaacttacaaagtaaccttntattagtattcgtagacgtaatacgaacctaaaccgtaacgaaaaccggacggaacgacgggactagttacgtaattagttgttagtttaagttacgtttaatacgtacgtaacggtaacttacgtaccg

SEQ ID NO: 438678 - DNA, 660 bp, Homo sapiens
  misc_feature: GZ8MTXP02JYWQX.44.36.D03.1.454.CMB.2.raw
  modified_base (411)..(411): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacttggtccagccgtgggacgggtccctgagactctcctgtgtcgcctctggattcacatcagtcgaccactatagtggacgtcgggtccgccgaggtcctccggaaggggaacggggcgtggggaggtcgggcgttcggggccgaccgaaaacgtaaaaaacgaaaggttcgaccagttactttancaacagacgtaccgaccgtcgtctaggtacgaaaacgcccaagtactttcccaaccccgttctaccgaaaggtacgaagtacgtaacctttacgaaacgtaactcttaagtttgtaactttcgaggtaaccgtaattacgaacctaaacgtaacggaaaaccggacggaaccgacggggtactattaggttaattagtttgtttgtttgtttagtttactacgttacgaacggtaccttcggtaacccg

SEQ ID NO: 438679 - DNA, 704 bp, Homo sapiens
  misc_feature: GZ8MTXP02JGTVH.44.36.D03.1.454.CMB.2.raw
  modified_base (204)..(204): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggacccccggnaggagggtcatcatctcttgttctggaagcagttccaacatccggaccctaattctgtatattggtaccagcaacgtcccaggaacccgacccccaaactcctacatctatagactaatcagccgccctcgacggggtccctagaccgtattctcccgtcggcctaccaagtcctacggccacccgttccgaacggtcccccttccccgtcgggtacccctaacgttcccgtaacgggtcccgggggtaccccccggtaccgggaacggggtaacccggtagggtttacgtaaccgtttaaccgtaaccgttcggaccgaccgtaacggtccggtttaggggacttccggacccgccgttaggacgggtcgttcgggtcgttcggttccggggacggacggaaccgtaacgtcgacccgtcgtacggtaccgaccgacccggaacggcccgtaaccgcccccgtcggtactaccgttccgttcccgtacccctacccccg

SEQ ID NO: 438680 - DNA, 594 bp, Homo sapiens
  misc_feature: GZ8MTXP02F8X94.44.36.D03.1.454.CMB.2.raw
  modified_base (324)..(324): a, c, t, g, unknown or other
  modified_base (352)..(352): a, c, t, g, unknown or other
  modified_base (380)..(380): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctacagtacatctctagaagagctagtttaaccatctaccaagaccacctacaaaggcaggtgtcttagtatgaccaanatcgacctgcgacaccagcacatatacngtgcgaacggggtaatggacgggaaaanaaacgagtcttggtttctagtaattataagttactacctatctggacgtgtaggggacaaagggacctacggtacctaccggtcctccctcgacgtccttacccgaaccgtaaccgggccctacgttcccggttccccttcccccgtcggcccgtcccgtcgcctcccgaggaaccgccgtacccgtcggtcgggggacaaccggacggcccgg

SEQ ID NO: 438681 - DNA, 581 bp, Homo sapiens
  misc_feature: GZ8MTXP02IF2X4.44.36.D03.1.454.CMB.2.raw
  modified_base (268)..(268): a, c, t, g, unknown or other
  modified_base (308)..(308): a, c, t, g, unknown or other
  modified_base (377)..(377): a, c, t, g, unknown or other
  modified_base (380)..(380): a, c, t, g, unknown or other
  modified_base (454)..(454): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaggtgtccagagtgaagtgcagttggtggaggtccgggggagacttggtccagcctggagggtccctgagactctcctgtgtcgcctntggattcaccatcagtgaccactatatggactgggtcccnccgaggctccgaggggaacgggctgggagtggcttgggccacaaagtaaaacaagttgaccagtctttncanagagtaccgcgcgtctgtagaaagccagtacttccaccctcgtacaagacgtatcgaacttacaaagtaccttnatttgatttcgagacgaatacgaacctaaacctaggaaaacccgaggaccacggggctaaagttgttaatttacgtttgtaggttttgttaggttttaatacctagacgggtaactttcgggacccg

SEQ ID NO: 438682 - DNA, 580 bp, Homo sapiens
  misc_feature: GZ8MTXP02F2TMK.44.36.D03.1.454.CMB.2.raw
  modified_base (337)..(337): a, c, t, g, unknown or other
  modified_base (369)..(369): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttaggaaaatataaccttgtctcttggtacaagtactacccaagtaaaccccccaaactccttactttatagaagtcaataagcggcctcggctatttcnctatcgcttctcacgctccaagtctggcaacncggctcgtgattaattctgcctctgcctgacgacgagccgactattatgactgctcatatgcggtctagtactagttcgggtcgttcgggcggtacggggaccggtccgtcggtacccgttccgtacggtaccgacggaccccgtaaacggcccttccggccccccgttcgggtcctaccgttccttccggttcccccgtcccctttcccg

SEQ ID NO: 438683 - DNA, 578 bp, Homo sapiens
  misc_feature: GZ8MTXP02JRZVS.44.36.D03.1.454.CMB.2.raw
  modified_base (547)..(547): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctaccaagacacctacaaagcaggtgtactttagtatgaccaacatcggaccctgcggacaccgagcacatattactgtgcgtaacgggtaatggaacgggaaaagaaacagtacgttggtttactgttattataacgtcttaccatcgtaggtacgtgtaggggacgaaagggccgacggtccaccgtctcctcacgtcctaccgaccgtaacgggcccacgtcccggttcccttcccccggtcggcccgtcctcgccgtccgacgggcnccgaccgtcggtcggggaccacgcggcccgg

SEQ ID NO: 438684 - DNA, 586 bp, Homo sapiens
  misc_feature: GZ8MTXP02IC6Q6.44.36.D03.1.454.CMB.2.raw
  modified_base (269)..(269): a, c, t, g, unknown or other
  modified_base (296)..(296): a, c, t, g, unknown or other
  modified_base (388)..(388): a, c, t, g, unknown or other
  modified_base (391)..(391): a, c, t, g, unknown or other
  modified_base (403)..(403): a, c, t, g, unknown or other
  modified_base (414)..(414): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaggtgtccagagtgaagtgcagttggtggaggtccgggggagacttggtccagcctggagggtccctgagactctcctgtgtcgcctntggattcaccatcagtgacctactatntggacgttgggtcccgccgaggcctaccggaggggaaggggctgggagtggcgttggccgcaaagtaaaaacaagttcgacctagtctttancanagagtacgccgntctgtagaacnccagacttccacccttctacaaagacgtatagaacctttacaaagaacttcaagtttcgaatttcgagtacgaagtcgaactaaacccgtagaaaacccggagaccgacgggctaagttgttattacgtttgtattgttacgtttatattacgacggtaacttcgtaacccg

SEQ ID NO: 438685 - DNA, 565 bp, Homo sapiens
  misc_feature: GZ8MTXP02G767G.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaaggggctgggagtggctggccgcaagtaaaaacaagttgaccagtctttatcacagagtaccgccgcgtctgtagaaagccagtacttccaccctctacgaagacgtatcgacttaccaaagtactcattgattcagacgaatgtaacctaaaccgtagaaaacccgaggaacctacgggactagtacgttagtttattcggttagtttgttagtttactatacgaaggtacttcgtaccg

SEQ ID NO: 438686 - DNA, 565 bp, Homo sapiens
  misc_feature: GZ8MTXP02F2ITM.44.36.D03.1.454.CMB.2.raw
  modified_base (465)..(465): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaagccctggagtggcttgcacacatcttctcgaatgaacgaaaaatcctacagtacatctctgaagagcagtttaaccatctccaagacacctaccaaaaggcaggtgtctttagtatgaaccaacatggaccctgcggacacaggcacatattactgtgcgacggggtaaatgacgggaaaagaaacgagcgttggtttactagtaattaataagtacttaccatctggactcgtaggggacaaagggccacggtcaccgtctcctnacgccttaccaccgaaacgggcccaagtccggtcccttcccccgcggtccgcccctgcctccaggaacgcgaccgtcggcggggacaccgacggcccggg

SEQ ID NO: 438687 - DNA, 710 bp, Homo sapiens
  misc_feature: GZ8MTXP02IPI21.44.36.D03.1.454.CMB.2.raw
  modified_base (322)..(322): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaagcctggagtggcttgcacacatcttctcgaatgaacgaaaatcctaacagtacatctctgaagagcagtttaaccatctaccaaggacacctaccaaagcaggtgttacttagtatgaccaanatacggaccctggacgacaccgacgacactattatacgtgcgacggtaacggtagtacggaacgggaaaacaacgtacgtaccgtttagttacgttaagtttaaacgttaacgttaaaccgtttaccttaaacgtacgtttacgggtacggtaccggtgggtaaaccgggggaaaccggtaaaccgggaaccccggttacgggtaaccctacccgggttccttaccctaccgcggttacccctaacccgaacccggaacccggtcccttaacggttccccgttccccctttcccggccgtccccgtaccgttccgaacccgtcggaaaccgccgtaccctacccggttcggggtaccggggacccaaaccggtcccggcccccggggg

SEQ ID NO: 438688 - DNA, 612 bp, Homo sapiens
  misc_feature: GZ8MTXP02H02KQ.44.36.D03.1.454.CMB.2.raw
  modified_base (309)..(309): a, c, t, g, unknown or other
  modified_base (371)..(371): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgctgggttttccttgttgctattttagaaggtgtccactgtgaggtgcggctggtggagtcgtgggggagcttgggtacgaggcggggggtccctggagactctcctgtgcagcctctggattcatcttcagtgactatgcctatgaacgtgggtccncgaggctccgaggggacggggctgggagtgggtttcagttattagttaatagttgctggganactacccgaccttactcgactagactcgtaggtgaacgggccgtaatttaccaaccctaagttacccgaagggtacaaacgtacgaccgaaagtaactcctaactaggttaactcgtaaggaaacttacgaaactacgacctaggacgaagacggaaggaccaacggggtacttcggtacctttacttcgttaaggttccggaaaggacggtaacgtcccggggtaccttaaggtttcggg

SEQ ID NO: 438689 - DNA, 639 bp, Homo sapiens
  misc_feature: GZ8MTXP02IM8I7.44.36.D03.1.454.CMB.2.raw
  modified_base (388)..(388): a, c, t, g, unknown or other
  modified_base (409)..(409): a, c, t, g, unknown or other
  modified_base (418)..(418): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtcagagtgaagtgcagttggtggaggtccgggggagacgttggtccagccgtggagggtccctgagactctcctgtgtcgcctctggattcaccatcagtgaccatatatggacgtgggtccgccaggcctccggaggggaaggggctgggagtggcgttgggccgacgaaagtaaaaaacaagttcgaccagtactttancaacagagtaccgccgcgtcngtagaaacnccaagacttcccaacccttcacaaagagattacggacctttacgaaaagtaaccttntaattagtacttcgtagaacgtaaattacgaaacccttaaaaccgtaaacgaaaaacccggacggaaccgaacgggtactaaagttacgtttaacgtttagtttaggttagttttaaggttaagttttaagtaccgtacgtaaacggttaaccttcggtacccg

SEQ ID NO: 438690 - DNA, 766 bp, Homo sapiens
  misc_feature: GZ8MTXP02HRKWF.44.36.D03.1.454.CMB.2.raw
  modified_base (270)..(270): a, c, t, g, unknown or other
  modified_base (273)..(273): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagcttgggttttccttgttgttattttacaaggttgtccagagtgaagtgcagtcggtggagtccgggggagacgttggtccagccgtgggacggtccctgagactctcctgtgtcnctntgattcacatcagtcgaccatatatggacgtcgggtcccgccgaggcctaccggagggggaacggggtcctaggggaggttcgggaccgtttcggggccccgtaacgtaaaacggttaaaaaaaccgaaggtttccggaccgtacggttacttttagtaccaacgtaaggtaccgtacccggccccggtacgttcctaggtacgaaaacggtcccaaaggtcctttacccacccttctaacgaaaggtactaaattcggtaaacctttacgaaaaggttaccttacgtaatttaggtactttaccgtaggtaaaccggtaaagtaccgtaaacccgttaaaaccggtaaacgggaaaaaacccccgggtagggaaaaccccggtaaacggggctaaaaggtttacggttaaatttaacgtttgggttaggttttaagttaggtttttaaaactacggttaacgttacggtaaacgtttttccggaaaccccgg

SEQ ID NO: 438691 - DNA, 608 bp, Homo sapiens
  misc_feature: GZ8MTXP02F21IN.44.36.D03.1.454.CMB.2.raw
  modified_base (308)..(308): a, c, t, g, unknown or other
  modified_base (373)..(373): a, c, t, g, unknown or other
  modified_base (418)..(418): a, c, t, g, unknown or other
  modified_base (497)..(497): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccnccaggctccgaggggaggggctgggagtggcttggccgcaagtaaaacaagttgccagtctttancacagagtacgccgcgtctgtagaaagccaagacttccacccctntacaagagatgaaccttcaaagtaacctcaatttgatttctgacgaattcgaaccttaaacccgtaggaaaaaccccgngggaaaccacggggactaagtttaggttaaattttaacgtttggttagttttaaggttttaacgttttaaatacgttaacggtaaacggttaaccttcggttaaaccccgg

SEQ ID NO: 438692 - DNA, 564 bp, Homo sapiens
  misc_feature: GZ8MTXP02HEUQ6.44.36.D03.1.454.CMB.2.raw
  modified_base (409)..(409): a, c, t, g, unknown or other
  modified_base (445)..(445): a, c, t, g, unknown or other
  modified_base (452)..(452): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctggtggagtcgtgggggagcttgggtacagggcggggggtccctggagactctcctgtgcagcctctggattcatcttcagtgactatcgcctatgaacgtgggtcccgccaggctccggaggggaacggggctggggtaggttgggtttaccattagtagttaaattattggctgggagtactacccacctactacgcagactngtagaggcattcaccatcgagacatcgacaagactnactgtancgtaggaatcgaactacgactagaacggagaacggacggacgaaccgggtctacggtaccttactttacgtcggttacgaaggacgtacgtccggggaccctaggtttcggg

SEQ ID NO: 438693 - DNA, 562 bp, Homo sapiens
  misc_feature: GZ8MTXP02F8OHI.44.36.D03.1.454.CMB.2.raw
  modified_base (314)..(314): a, c, t, g, unknown or other
  modified_base (531)..(531): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctacaagacactacaaagcagtgtcttagatgaccanatcgacctgcgacacagcacatatactgtgcacggtaatgacggaaaagaaacagcttggtttctagttaattataaagttctaccatcgtaggacgtgtaggggacaaagggacccgtaggtccaccgtctcctcacgtccttaccaccgaaacggccctaacgtccggttacccttcccccgtggccccgtcccttcgccctccgaagggaaccnccaccgtcggcgggggaccacgacggcccgg

SEQ ID NO: 438694 - DNA, 589 bp, Homo sapiens
  misc_feature: GZ8MTXP02FTH7W.44.36.D03.1.454.CMB.2.raw
  modified_base (372)..(372): a, c, t, g, unknown or other
  modified_base (467)..(467): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgcaggctccgaggggaaggggctgggagtggcttggccgcaagtaaaaacaagttgccagctttancacagagtacgccgcgtctgtagaaagccaagtacttccacccctctacaaagagatgaacctttcaaagtaaccttcaatttaggaatttccgnggacgtaaattcgaaccttaaaccgtagaaaaacccggagggaccgaacgggggcaaagttcggtaatttacgttggttagttaagttgtttaatactacgtaagggaactttcggtacccg

SEQ ID NO: 438695 - DNA, 694 bp, Homo sapiens
  misc_feature: GZ8MTXP02JRY0A.44.36.D03.1.454.CMB.2.raw
  modified_base (385)..(385): a, c, t, g, unknown or other
  modified_base (559)..(559): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtgggttttccttgttgttatttacaaggtgtccagagtgaagtgcaggttggtggaggtccgggggagacttgggtccagcctgggagggtccctgagactctcctgtgtcgcctctggattcaccatccagtgaccactatatggactgggtcccgccaggctccgaggggacggggctgggagtggcttgggccgacgaaagtaaaaaacaagttcgaccgtagtctttaancaacaggacggtaccgcccgtagtcctaggtacggaaaacgtcccaagtacttcccaacccttcaaccaaagagatacgtaccttacgaaaacgtaactaccgtaatttagtaactttcgtacggaaccggtaaatacgaaacccttaaaacccggaacgggaaaaaaccccgnggaaccgaaccggggataacgttagggttaatttaaggtttggttcgtttaggttaacgttttaataacgttaacgtaaagggtaaaccttcgggtacccgtaacggggttccgggggacccgtaaaaccggggg

SEQ ID NO: 438696 - DNA, 555 bp, Homo sapiens
  misc_feature: GZ8MTXP02G8N2F.44.36.D03.1.454.CMB.2.raw
  modified_base (223)..(223): a, c, t, g, unknown or other
  modified_base (270)..(270): a, c, t, g, unknown or other
  modified_base (307)..(307): a, c, t, g, unknown or other
  modified_base (343)..(343): a, c, t, g, unknown or other
  modified_base (368)..(368): a, c, t, g, unknown or other
  modified_base (371)..(371): a, c, t, g, unknown or other
  modified_base (419)..(419): a, c, t, g, unknown or other
  modified_base (439)..(439): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctcnggattcaccatcagtgaccatatatggactgggtccncaggctccgagggaaggggctggagtggcttggccncaagtaaaaacagtgccagctttancanagacgtacgcgcgtctgagaaacgcatactcccaccctacacaaaganatacgacttacaaagtactntattgattcagactaatacgaaacctaacgtaacgaaaaccgaggaaccgacggacagttagttacttagttgttagttaagttagtttaatacgtagaacggtaacttcgtaccg

SEQ ID NO: 438697 - DNA, 701 bp, Homo sapiens
  misc_feature: GZ8MTXP02FUCFX.44.36.D03.1.454.CMB.2.raw
  modified_base (317)..(317): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccgggggagacttggtccagccgtgggacgggtccctgagactctcctgtgtcgcctctggacttcaccatcagtcgaccactatagtggacgtcgggtcccnccaggctccggaggggagggctgggagtcggcttcgggccgactaaaagtaaaaaccaagttcgaccagttctttagcaacgagacgtaccgcgcgtctagtagaaacgcaagtacttacccaccctctaacgaaagagtatacgtaaccttacgaaacgtaacctactagtttagtaactttccgtaggtaccgtaaatttacggaaaaccctttaaacccgtaaaacgggaaaaaaccccgggacggggtaaacccgaaaccgggggtacttaaaaggtttacgttttaaacgtttttaacgttagggttttggttttaaggtttaccggttttaaagtttactaccggtaaaaggggtaaacctttcggttaaaccccggg

SEQ ID NO: 438698 - DNA, 607 bp, Homo sapiens
  misc_feature: GZ8MTXP02G1T0Z.44.36.D03.1.454.CMB.2.raw
  modified_base (217)..(217): a, c, t, g, unknown or other
  modified_base (372)..(372): a, c, t, g, unknown or other
  modified_base (379)..(379): a, c, t, g, unknown or other
tcagacagtatatacacgaccggtgctcgatttagctgcgtcacgatctctcttgggggagagtggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctcctgtgtcgcctctggattcaccatcagtgaccactatatggactgggtccgcaggctccgaggggaagggctgggagtgggcttggccgacaagtaaaaacaagttcgaccagtctttancaacagngtacgccgtcgtctgtagaaaacgcccaagacttccgaaccctctacaaagagatgaacttacaaagtaactcaattgattctagaccgaaatagaacctaaaccgtaaggaaaaacccgagggaaccacggggacctaagttagttaaatttaagttcggttagtttagttagtttaactataacgaaggtaactcgtaccgtaacgtcgggggacctaaaccgggg

SEQ ID NO: 438699 - DNA, 526 bp, Homo sapiens
  misc_feature: GZ8MTXP02F3D70.44.36.D03.1.454.CMB.2.raw
  modified_base (306)..(306): a, c, t, g, unknown or other
  modified_base (346)..(346): a, c, t, g, unknown or other
  modified_base (370)..(370): a, c, t, g, unknown or other
  modified_base (378)..(378): a, c, t, g, unknown or other
  modified_base (425)..(425): a, c, t, g, unknown or other
tcagacagtatatacacgaccggtgctcgatttagctgcgtcacgatctctcttggggagctctgggagaggagcccagcaccagaagtcggcggtgtttccagtcggtgatcagcaccgaacacagaggactcaccatggagtttgggctgacctgggttttcctcgttgctcttttaagaggtgtccagtgtcaggtgaagctggtggagtcgtgggggagcgtggtccagcctgggagtcctgagactctcctgtgtagcgtctggattcaccttcaacagacatggcatgcacgtgggtccnccaggctccgagcgaagggctggagtgggtgcctacttanagtggtatgatggaataataaatnttatgtanattcgagacggcattcactatctacagagacattacgaaagaaccanactatatacagaaatgaatacgctagacgagaccgagggacacgggactcgtacctaacgtacgtaggtcgacggagaaggtggtacggggcttacggagg

SEQ ID NO: 438700 - DNA, 601 bp, Homo sapiens
  misc_feature: GZ8MTXP02GZ0UF.44.36.D03.1.454.CMB.2.raw
  modified_base (224)..(224): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagcctggagggtccctgagctctctgtgtcgctctggattcacatcagtgaccactatatggactgggtccgcaggctccgagggagggctggagtgctggccgacaagtaaaacaagttcgacctagtctttatccaacagacgtaccgccgtcgtctgtagaaacgcccaagtacttccgaaccctctacgaaagtagattcgtaaaccttcgaaaagaaaccttctaatttcgaatttccgagaccgtaaatcggaaaccttaaaccgaacggaaaaacccggcggaaaccgacgggtactaagttcgttaactttagttgttgttaagttagtttaactacgtagtacggtaacttcgtaccg

SEQ ID NO: 438701 - DNA, 584 bp, Homo sapiens
  misc_feature: GZ8MTXP02G3K3B.44.36.D03.1.454.CMB.2.raw
  modified_base (210)..(210): a, c, t, g, unknown or other
  modified_base (277)..(277): a, c, t, g, unknown or other
  modified_base (315)..(315): a, c, t, g, unknown or other
  modified_base (376)..(376): a, c, t, g, unknown or other
  modified_base (379)..(379): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggnggaggtccgggggagacgttgggtccaggccgtgggacgggtccctgagactctcctgtgtcgcctntggattcaccatcagtgaccatatatggactgggtccncaggctcgagggagggctggagtggctggccgacaaagtaaaaacagttgaccagtctttncanagagtaccgccgcgtctgtagaaagccaagtacttcccacctctacaaagagatgtacttacaaagtaactacaatttcgaattcgaggacctaaagtacgaacctaaaccgtaacgaaaaacccggaggaaccgacggggactaagttacgttatttagttgttagttaagttagtttaactatacgtaacgacttagtacccg

SEQ ID NO: 438702 - DNA, 554 bp, Homo sapiens
  misc_feature: GZ8MTXP02JEP2V.44.36.D03.1.454.CMB.2.raw
  modified_base (309)..(309): a, c, t, g, unknown or other
  modified_base (347)..(347): a, c, t, g, unknown or other
  modified_base (374)..(374): a, c, t, g, unknown or other
  modified_base (455)..(455): a, c, t, g, unknown or other
  modified_base (488)..(488): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtccncaggctccgaggggaaggggctggagtggcttgggccncaagtaaaaacaagttgccagctttancacagagtacgcgcgtctgtagaaagccagacttcaccctctacaagagatgaacttacaaagaacttcaattgaatttcngacgaaatgaacctaaacctaggaaaaacccgnggaacgacggggcaagttgtaatttagttggtgtttgtgtttaactatcaagggtaactggtaccc

SEQ ID NO: 438703 - DNA, 578 bp, Homo sapiens
  misc_feature: GZ8MTXP02GZ5Z6.44.36.D03.1.454.CMB.2.raw
  modified_base (327)..(327): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcatcaccatctcctgcactgggtccagcaatgacattgggagatataaccttgtctcctggtatcaaacaacatccaggacaaacgcccccaaactcattacttttgagtccagtgagcggccgtnaggttgtttctaatcgcttctctggctcaagtctcggccacaccggcctccctgtcgactctcgtgggcctccggctgacggacgaggctagacttatacgtgcgctactatttacaacttcttagtagtacgtttggggtcgtttcgggacggtaacggggtacctccgtaacccgttcggtaccccgttaaccgttaacggttcccgaacggtaccccgaaacgggtccccgttaccggtcccccccgg

SEQ ID NO: 438704 - DNA, 700 bp, Homo sapiens
  misc_feature: GZ8MTXP02JNSMO.44.36.D03.1.454.CMB.2.raw
  modified_base (316)..(316): a, c, t, g, unknown or other
  modified_base (411)..(411): a, c, t, g, unknown or other
  modified_base (672)..(672): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacgttgggtccaggccgtgggagggtccctgagactctcctgtgtcgcctctggattcaccatcagtcgaccactatatggactcgggtccnccgaggcctccggaaggggaacggggctggggagtcggcgttcggggaccgaccgaaaggtaaaaaaccaaggttcgaccctaaggtccttttanaccaacgaaggtaacgtaccgcccggtcgtcgtggtacgaaaacgcccaagtactttcccaaccccttcaacgaaaggagtaacttcggtaaacctttacgaaaagtaacccttactaagtttaggtaaactttccgtaggaacccggttaaaattcggaaaacccttaaaacccgtaaggaaaaaaccccgggaggaacccgacgggggactaaggttacggttaaatttacgttggtttagtttggttacgtttttaanacgtacggaacggttaccgtcgtacccg

SEQ ID NO: 438705 - DNA, 577 bp, Homo sapiens
  misc_feature: GZ8MTXP02G859K.44.36.D03.1.454.CMB.2.raw
  modified_base (317)..(317): a, c, t, g, unknown or other
  modified_base (362)..(362): a, c, t, g, unknown or other
  modified_base (386)..(386): a, c, t, g, unknown or other
  modified_base (494)..(494): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgcttattttagaaggtgtccactgtgaggtgcggctgggtggagtcgtgggggagcgttgggtacgagggcgggggggtccctggagactctccgtgtgcagcctcgtggattcatcttcagtgactatcgccatgaacgtgggtccncgaggctccgaggggaggggctgggagttggttcatatgttaatntgctggatactaccactactacgnacgactcgtggtagaacggggcctaattccaacctaacgtttacccgaaggggaaccaagtacggacccaaagaccctacacttagtactacgtaggaaatcgaaacngaccgtagacgagacgaggaccaggcttcgtaccttacgttcgtaaggttcgaagacgtacgtccgggtacctacggtttcgg

SEQ ID NO: 438706 - DNA, 543 bp, Homo sapiens
  misc_feature: GZ8MTXP02I4S8M.44.36.D03.1.454.CMB.2.raw
  modified_base (375)..(375): a, c, t, g, unknown or other
  modified_base (394)..(394): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctggagggtccctgagctctcctgtgtcgcctctggattcaccatcagtgaccactatatggactgggtccgccaggctccgaggggaggggctgggagtggcttgggccgacaagtaaaaacaagttgaccagtctttancacagagtacgccgcgtcngtagaaagccaagtacttccacccttctacaaagagatgaacttcaaagtactcatttgaattctggactaatagacctaaactagaaaaaccggaggacacgggcaagtgtattattgtgttgtagtttatatcgaggtactgtaccg

SEQ ID NO: 438707 - DNA, 747 bp, Homo sapiens
  misc_feature: GZ8MTXP02GAWLS.44.36.D03.1.454.CMB.2.raw
  modified_base (365)..(365): a, c, t, g, unknown or other
  modified_base (396)..(396): a, c, t, g, unknown or other
  modified_base (446)..(446): a, c, t, g, unknown or other
tcagacagtatatacacgaccggtgctcgatttagctgcgtcacgatctctcttggggagctctgggagcggagccccagccccagaattcccaggtgttttcatttggtgatcagcactgaacacagaggactcaccatggagttcgggctgagctgggttttccttgttgttattttacaaggtgtccagagtgaagtgcaggttgggtggaggtccgggggagtacgttgggtccaggccgtgggacgggtccctgagctctcctgtgtcgcctctggattcaccatcagtcgaccactatatggactggggtcccgccaggctccggaggggaaggggctgggaggtggcgttggcccganaaacgtaaaaacaagttcgaccagtctttancacagacgtaccgccgcgtctgtagaaacgccagacttaccacccgttanaccaaagtacgatacgaaacctttaacgaaaacggtaaccttactaagtttaggtaaacttttccgtacggtaaccggttaaattacgtaaaacccgtttaaaacccgtaaacgggaaaaaaaccccgggtaacgggggtaaacccgaaaccggggggtacccttaaaacggtttacgggtttaaaatttttaacggtttcgggtttagggtttttaggtttaaggtttttaaacgttaacgtttaccggtaaaagggggtttaaacctttcggggttaacccccgtttaaacccgggggg

SEQ ID NO: 438708 - DNA, 538 bp, Homo sapiens
  misc_feature: GZ8MTXP02J1QFG.44.36.D03.1.454.CMB.2.raw
  modified_base (376)..(376): a, c, t, g, unknown or other
  modified_base (395)..(395): a, c, t, g, unknown or other
  modified_base (417)..(417): a, c, t, g, unknown or other
  modified_base (424)..(424): a, c, t, g, unknown or other
  modified_base (433)..(433): a, c, t, g, unknown or other
  modified_base (480)..(480): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaaggggctgggagtggcttggccgcaagtaaaaacaaagttgaccagctttancacagagtacgccgcgtcngtgaaagccagattccaccctntacaagngatgacttnaaagactcattgattctgacgtaatgaactaaacctagaaaacccgnggacacgggcaagtgtattattggttagttgttgtttatatcgaggtaactcgtaccg

SEQ ID NO: 438709 - DNA, 522 bp, Homo sapiens
  misc_feature: GZ8MTXP02FI8NJ.44.36.D03.1.454.CMB.2.raw
  modified_base (371)..(371): a, c, t, g, unknown or other
  modified_base (413)..(413): a, c, t, g, unknown or other
  modified_base (420)..(420): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgctctggattcaccatcagtgaccactatatggactgggtccgccaggctccgaggggaggggctgggagtggcttggccgcaagtaaaacaagttgaccagctttancacagagtacgccgcgtctgtagaaagccagacttcaccctntacaagngatgacttacaaagactcattcgattctgacgaatgaactaactagaaaaccgagacacgggcatgtattatgtagttgtgtttanatcaaggactgtaccg

SEQ ID NO: 438710 - DNA, 639 bp, Homo sapiens
  misc_feature: GZ8MTXP02HIPT1.44.36.D03.1.454.CMB.2.raw
  modified_base (223)..(223): a, c, t, g, unknown or other
  modified_base (269)..(269): a, c, t, g, unknown or other
  modified_base (308)..(308): a, c, t, g, unknown or other
  modified_base (371)..(371): a, c, t, g, unknown or other
  modified_base (374)..(374): a, c, t, g, unknown or other
  modified_base (391)..(391): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctntggattcaccatcagtgaccatatatggactgggtcccnccaggcctccgaggggaggggctggagtggctggccgcaagtaaaacagttgccagtctttancanagagtaccgccgcgtcngtagaaacgcccaagtacttccgacccttctacaaagagatcgaactttacgaaaagtaaccttctaatttaggaactttccgaggaccgtaaaattcggaaaacccttaaaaccggtacggaaaaaaccccggtaagggaacccgaacgggggtacctaaagtttacggttaaatttaacgtttggttacgtttaaggtttacgttttaaagtacttacggtaacggtaaacctttcggtaaccccg

SEQ ID NO: 438711 - DNA, 733 bp, Homo sapiens
  misc_feature: GZ8MTXP02HBN3T.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagtcttgggttttccttgttgttatttacaaggtgtccagagtgaagtgcaggttggtggaggtccgggggagtacgttggtccaggccgtgggacgggtccctgacgactctcctgtgtcgcctctggattcaccatcagtcgaccactatatggactcgggtcccgccaggcctccgaggggagggctggagtggctggccacaagtaaaaacagttcgccagtctttagcacagacgtaccgccgcgttctgtagaaacgcccaaggtactttacccaacccctttcgaaccgaaaaggtaacggtaattacgggtaaaccccttttaacgaaaaacggttaaaccctttaccgtaaatttttagggaacttttaccgttacgggaaaccgtaaaagtttaccggaaaacccctttaaaacccgtaagggaaaaaaaacccccgggtaggggaaaacccggtaaccgggggaacctaaaggttttacgttaaacgtttttaacgtttggttaggttttaagtttaacggtttttaaatacgttaccgtaaaaggggttacctttacggtaaccccgg

SEQ ID NO: 438712 - DNA, 570 bp, Homo sapiens
  misc_feature: GZ8MTXP02G6OPT.44.36.D03.1.454.CMB.2.raw
  modified_base (309)..(309): a, c, t, g, unknown or other
  modified_base (372)..(372): a, c, t, g, unknown or other
  modified_base (418)..(418): a, c, t, g, unknown or other
  modified_base (426)..(426): a, c, t, g, unknown or other
  modified_base (444)..(444): a, c, t, g, unknown or other
  modified_base (455)..(455): a, c, t, g, unknown or other
  modified_base (535)..(535): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagctctcctgtgtcgcctctggattcaccatcagtcgaccatatatggactgggtcccnccaggctccgaggggagggctgggagtgctggccacaagtaaaaacagttgcccagtctttancacagacgtacgccgcgtctgtagaaacgccagacttccacccttnacaagganatgacttcaaagtacctnattgacttcgngacgtaatcgaaccttaaccgtaagaaaaccccgaggaccgacggctagttagtacgtttattggttagtttaaggtttntttaactattaccgaagggttaacctgtaaccccg

SEQ ID NO: 438713 - DNA, 585 bp, Homo sapiens
  misc_feature: GZ8MTXP02JW93E.44.36.D03.1.454.CMB.2.raw
  modified_base (380)..(380): a, c, t, g, unknown or other
  modified_base (396)..(396): a, c, t, g, unknown or other
  modified_base (523)..(523): a, c, t, g, unknown or other
  modified_base (563)..(563): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctggagggtccctgagactctcctgtgtcgcctctggattcaccatcagtgaccactatagtggactgggtccgccaggctccgaggggagggctgggagtggctgggccgaccgaagtaaaaacaagttcgccagtctttancaacagagtacgccgngtcgtgtagaaacgccaagtacttcccgaaccctctacgaaaggatatacgtaaccttcaaaagtaacccttgaatttggtactttcgtaggactaaagtcgaaaccttaaaccgagaaaaaccggnggaaccgaggctagtagtattattggtgttgtagtttaanactacgacggtactcggtaccg

SEQ ID NO: 438714 - DNA, 722 bp, Homo sapiens
  misc_feature: GZ8MTXP02GYBJG.44.36.D03.1.454.CMB.2.raw
  modified_base (205)..(205): a, c, t, g, unknown or other
  modified_base (234)..(234): a, c, t, g, unknown or other
  modified_base (450)..(450): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtcgtcgggacccccggnaggaggtcatcattctcttgttctggaanctagttaccaactagtccggcccttaattctagtatattcggtaccagcaacgtccccaaggaaaccccgaccccctaaactccctacaattcctaagtaacggaactaacgtcgaacggcccggtccccttacggaaccggggttcccctagacccgtatttccgtccgttcggcctaccgaagtctcggccaccctcaccggtccccttcccgnggaccctagtccgacggtccggggtcccccgtacggacgggacgtaggttacgtacttacgtacgtcgcgcgtaaggtccggttaggacgttaccggacccgtcggtagggacgggtcgttcgggtcgttcgggttaccggggaccggaaacgggggaaccctaaaacggtccgggtaccgttaccgacgggtaccgaccggacccggtaacggcccgtcccggtacccccgttcggtaccctaccctccgttcccgttaccccctaccccg

SEQ ID NO: 438715 - DNA, 639 bp, Homo sapiens
  misc_feature: GZ8MTXP02GMLFF.44.36.D03.1.454.CMB.2.raw
  modified_base (271)..(271): a, c, t, g, unknown or other
  modified_base (309)..(309): a, c, t, g, unknown or other
  modified_base (372)..(372): a, c, t, g, unknown or other
  modified_base (375)..(375): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctntggattcaccatcagtcgaccatatatggactgggccncaggctccgaggggagggctgggagtggcttggccacaagtaaaaacagttgccagtctttancanagagtaccgcgcgtctgtagaaacgcccaagtacttacccgaccccttctacaaacgaagactacgtaaccttacaaagtaactactaatttgaactttccgtagtaccgtaaatacggaaccttaaaacccgtaacggaaaaacccggaacgggtaacccgaacgggggtacctaagttacggttaaactttacgtttaggttaggtttaagtttagtttttaacgttacgtacgtaacggggtaaaccttcggttaaccccg

SEQ ID NO: 438716 - DNA, 730 bp, Homo sapiens
  misc_feature: GZ8MTXP02HUOH8.44.36.D03.1.454.CMB.2.raw
  modified_base (325)..(325): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctgggagtggcttgcacacatcttctcgaatgaacgaaaatcctaacagtacatctctgaagagcagtttaaccatctaccaagacacctacaaaggcaggtgtacttagatgaccaantagacctgcgacacgagcacatattactgtgacgtaacggtaatcggaacggggaaaagaaacaggtccgtttaggtttacctagtttaaatttaagttaaacgtttacctttaaccgttaacgttcgttacgggtaccggttcggttacgggggaaccgtaaaacggggtaacccgtaaccgggttaccctaacccgggttacccttccctacgtaccggttacccttaccccgaaacccgggaaaccggggtacccctaacggttccccggttaccccgttttccccccggacgggtcccccgttccccggtttcggaccccgttacccgaacggggtaaccgcccggtaaacccggtttccggggacgggggacccaccgggttaaccgggtcccccggggg

SEQ ID NO: 438717 - DNA, 566 bp, Homo sapiens
  misc_feature: GZ8MTXP02JFCLE.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggccctggataagggtttgaatggatggtagggagctactcgtgggcaagtggtaacacaggctatgcacagaagtttcagggcagagtcaccatgaccagggacacgtccacgacgacacagcctacagtggagctgagcagtcagagactctagagacatagatgtagtactacgtgtgacgagaccggtagagacaagacaaagaaaagtagttcttagaactacgtacggggacaacgggtaaccctggtaccgaccgtcctaccgtacacgccctacgaccgacggccccagtcccgttacccgttcccccgtacggccctaaccccttccgacccgacgaaccgccctaacccgtcggcgggggaccacggaccgccggcccgtcgggtcccg

SEQ ID NO: 438718 - DNA, 609 bp, Homo sapiens
  misc_feature: GZ8MTXP02FWF3N.44.36.D03.1.454.CMB.2.raw
  modified_base (371)..(371): a, c, t, g, unknown or other
  modified_base (455)..(455): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccgcaggctccgaggggaagggctggagtggcttggccgcaagtaaaacaagttgccagctttancaacgagacgtaccgccgcgtctgtagaaacgcccaagtacttccaccctctacaaagacgatgtaacttacgaaagtaacctntaagtttgtaactttcgtaggacgtaaatacgaaaccgttaaaccgtaacggaaaaaccggacgggaaccgaacgggtactaaagttacggttaaactttagttgttagtttaagttacgtttaatacgtaacgtaacggtaacttcggtaccg

SEQ ID NO: 438719 - DNA, 567 bp, Homo sapiens
  misc_feature: GZ8MTXP02JB3RZ.44.36.D03.1.454.CMB.2.raw
  modified_base (275)..(276): a, c, t, g, unknown or other
  modified_base (302)..(302): a, c, t, g, unknown or other
  modified_base (336)..(336): a, c, t, g, unknown or other
  modified_base (426)..(426): a, c, t, g, unknown or other
  modified_base (440)..(440): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttgggccagcctgggacgggtccctgagactctcctgtgtcgctctggattcaccnncagtgaccatatatggactgggtccncaggctccgagggagggctggagtggctggccgnaagtaaaacagtcgaccagctttacacagcgtaccgcgcgtctgtagaaacgccaagtacttccaccctctacaagagatgacttacaanactcattgattcgngacgaatcgaacctaaccgtaggaaaaccgaggaaccgacgggactaagttgtaatttagttgttagtttgtagtttacatcgtaacggtaacttcggtaccctacggtcgggggaccctaacgggg

SEQ ID NO: 438720 - DNA, 599 bp, Homo sapiens
  misc_feature: GZ8MTXP02FYDPB.44.36.D03.1.454.CMB.2.raw
  modified_base (225)..(225): a, c, t, g, unknown or other
  modified_base (312)..(312): a, c, t, g, unknown or other
  modified_base (484)..(484): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaaggtgtccagagtgaagtgcaggttggtggaggtccggggganacttggtccagcctggaggtccctgagactctcctgtgtcgcctctggattcaccatcagtgacctactatagtggacgtgggtccncgaggcctccgaggggagggctgggagtggcttggccgacgtaaagtaaaaaaccaagttcgaccagtcttttagcaacagacgtaccgccgtgtctgtagaaacgccaagacttccaccctctacaagagtatacgaacttacaaagtaacttacagtttataactttcgngtacgaattacgaacctaaaccgtaacgaaaaccggacgacggaaccgggctagttagttacttagttgttggtttaagttagtttaatacgtacgtaaggtaactcggtacccg

SEQ ID NO: 438721 - DNA, 568 bp, Homo sapiens
  misc_feature: GZ8MTXP02IATT7.44.36.D03.1.454.CMB.2.raw
  modified_base (211)..(211): a, c, t, g, unknown or other
  modified_base (226)..(226): a, c, t, g, unknown or other
  modified_base (311)..(311): a, c, t, g, unknown or other
  modified_base (374)..(374): a, c, t, g, unknown or other
  modified_base (378)..(378): a, c, t, g, unknown or other
  modified_base (424)..(424): a, c, t, g, unknown or other
  modified_base (503)..(503): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggttgtccagagtgaagtgcagttggnggaggtccggggganacttggtccagcctggagggtccctgagactctcctgtgtcgctctggattcaccatcagtcgaccactatatggactgggtccncgaggctcgaggggagggctggagtggctggccgcaaagtaaaaacagtgacctagtctttancaanagacgtaccgccgtgtctgtagaaagcccagtacttcccacccttntacaaagagatacgaacttacaaagtacttctaatttgatttccgagacgtaatcgtaactaaccgtagaaaaacccgnggacgacgggatagtgttattagtttgtgtttgttcgtttaatactcgacggtaacttcgtaccg

SEQ ID NO: 438722 - DNA, 687 bp, Homo sapiens
  misc_feature: GZ8MTXP02GEMHU.44.36.D03.1.454.CMB.2.raw
  modified_base (427)..(427): a, c, t, g, unknown or other
  modified_base (586)..(586): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttgttattttacaaggtgtcagagtgaagtgcaggttggtgggaggtccgggggagtaccgttgggtccaggccgtgggacgggtccctgagactctctgtgtcgcctctggatcaccatcagtcgacctactatagtggaccgtggggtcccaccgagggcctaccgggaaggggggaacggggtcgtaggggagggtggccgttggggacccgtacgaaaaggtaaaaaaccaaggttcgacctaagttctttancaacgtaggacgtaccgcgtcgtctagtagaaaacgccaagtacttcccaccctctacaaggtacactgtaaccttacgaaaacgtactactatttagtaacttcgtagaccgtaaaattacggaaacccttaaaccgtaacgggaaaaaacccccggngggaaaacccgacgggggtaaacttagttaacggtttaatttaggtttgttaggtttcggtttatttaagtacttacgaaggttaacgttcggtaacccgg

SEQ ID NO: 438723 - DNA, 541 bp, Homo sapiens
  misc_feature: GZ8MTXP02H2498.44.36.D03.1.454.CMB.2.raw
  modified_base (391)..(391): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaggtgtccactgtgaggtgcggctgggtggagtcgtggggggagcgttgggtacgagggcggggggggtccctggagactctcctgtgcagcctctggattcatcttcagtgactatgccatgaacgtgggtcccgccaggctccgagggaaggggctggagtgggttccatatgtaatattgctggagataccacctactacgcagactcngtgaggcattcacattcgagggacaatcgacaagactagactagatcgaagaaacgtagaacacgaccgtagaagacgaacggagacgacgggctcgtacctacttacgtcggttacgaaggacgtacggtccggaccgttacgttacgg

SEQ ID NO: 438724 - DNA, 630 bp, Homo sapiens
  misc_feature: GZ8MTXP02IUQVZ.44.36.D03.1.454.CMB.2.raw
  modified_base (420)..(420): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacttgggtccagcctgggagggtccctgagactctcctgtgtcgctctggattcaccatcagtcgaccactatatggacgtcgggtcccgccgaggcctccggaggggaacggggtctgggagtggtcgttggccgacgaaagtaaaaacaggttcgacctagtctttatcaacgagacgtaccgccgtacgttcnggtagaaacgcccaagtacttcccacccttctacaaaggacgatcgtaaccttacaaagtaacttctaatttagactttcgtgaacgtaatacggaaccttaaaccgtacggaaaaaccgcgggaaaccgacggggactaaagttcgttaactttagtttggttagtttaagtttagtttacttagtacgtaaggtacttacggtacccg

SEQ ID NO: 438725 - DNA, 577 bp, Homo sapiens
  misc_feature: GZ8MTXP02HGT9R.44.36.D03.1.454.CMB.2.raw
  modified_base (234)..(234): a, c, t, g, unknown or other
  modified_base (312)..(312): a, c, t, g, unknown or other
  modified_base (362)..(362): a, c, t, g, unknown or other
  modified_base (372)..(372): a, c, t, g, unknown or other
  modified_base (388)..(388): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctgggtggagtcgtgggggagcttgggtacgngggcgggggggtccctggagactctccgtgtgcagcctctggattcatcttcagtgactatgccatgaacgtggtccnccgaggcctccggaggggagggctggaggttggttccagttatgttaatnttgcgtgganactaccacctactacncacgactctgtagaacgggcctaattccaacctaattccgaagggacaaagtcgaaccaaagaacttacactagtatcgtaaggaaatcggaaactacgaccgtagaaagacggaaaccggaggaaccacgggtacttcggtacctacgttcgtgttacgagtacgagtcccgggtacctacgtttcgg

SEQ ID NO: 438726 - DNA, 787 bp, Homo sapiens
  misc_feature: GZ8MTXP02FX10L.44.36.D03.1.454.CMB.2.raw
  modified_base (268)..(268): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaacggcccgtggagtggcttgcacacatcttctcgaatgaacgaaaactctacagtactatctcagaganactaacgttaacataccacgaacgaccaccctaaacgaaacggcgtaggttacgtttacgtttaagtacgtaccgaaaccaaacgtacggtaccgacccgtacggaacggaccgaaccgacgaccaactaattacttacgttagtcggacggtaaacgggtaaagtacgggaaacgggaaaacgaaacgtacgttacgtttggtttaacttagttaaagtttaaagttaaccgtttacttaaaccgtacgttacgggtacgggtacgtcggggttaacggggaaacgtaaaacggggtactacggtccggttaacccgtaccgttaccctaccgtacgtaaccgttacccgttaaccccgaaaccgggtaacccgggtaccccttacggtttcccccgggttaccccctttcccccgggtacgggacccccttccccgtaccggaccccttacccggaaaggggtcccccaaccggttcccggtaccgggggtacggaccccgaaccggtccccggggg

SEQ ID NO: 438727 - DNA, 585 bp, Homo sapiens
  misc_feature: GZ8MTXP02JF1VU.44.36.D03.1.454.CMB.2.raw
  modified_base (309)..(309): a, c, t, g, unknown or other
  modified_base (360)..(360): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttagaagtgtccactgtgaggtgcggctggtggagtcgtgggggaggtcttggtacaggcgggggggtccctggagactctcctgtgcagcctctggattcatcttcagtgactatgccatgaactggtccncaggctccgagggagggctggagtggttcatatgttaatattgctggagtntaccactactaccgcaagtactctagtacgaaacggggcctattaccacctaaattcccgaaggggaccaaagtcgaccaaagtacctcgaactgtaatccaaggaaactcgaaacgtagcctaggaagagaacggtacggaccgacggtcgtcggttactacccgtttacgtggttaccgaagaggtaaccgtccggggtaccctaggtttcggaccgtaaggg

SEQ ID NO: 438728 - DNA, 495 bp, Homo sapiens
  misc_feature: GZ8MTXP02FJ9Y8.44.36.D03.1.454.CMB.2.raw
  modified_base (190)..(190): a, c, t, g, unknown or other
  modified_base (318)..(318): a, c, t, g, unknown or other
tcagacagtatatacacgaccggtgctcgatttagctgcgtcacgatctctcttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccagtaaagccccaaatcatcatctatgagcctataagagcctnagggtttcaatcgcttcactgcctcagtccgcaacacgcctcctgacatctctggctccaggctgaggacgaggctgattattattgttgcttcagactgttcgtcgcattcactttatgtcttcggaaagtggaaccaggtcaccgtcaagtcacgcccaagccaaacccgctacg

SEQ ID NO: 438729 - DNA, 578 bp, Homo sapiens
  misc_feature: GZ8MTXP02FX2MZ.44.36.D03.1.454.CMB.2.raw
  modified_base (203)..(203): a, c, t, g, unknown or other
  modified_base (377)..(377): a, c, t, g, unknown or other
  modified_base (424)..(424): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggnggaggtccgggggagacttggtccagccgtggagggtccctgagactctcctgtgtcgcctctggattcaccatcagtgaccactatatggactgggtccgccaggcctccgaggggaggggctgggagtgggcttgggccgacgaagtaaaaacaagttcgaccagtctttancaacagcgtacgccgcgtctgtagaaacgccaagtacttccaccctntacaaagacgatgacttcaaaagactcaattgatttcagacgaatcgaactaacgtgaaaaccgaggacacgggcatagtattagttagttgttagttagtttatataacgtaggtaacttcgtaccgtacggtacggggtaccgaaaccgggg

SEQ ID NO: 438730 - DNA, 602 bp, Homo sapiens
  misc_feature: GZ8MTXP02FVN7I.44.36.D03.1.454.CMB.2.raw
  modified_base (377)..(377): a, c, t, g, unknown or other
  modified_base (380)..(380): a, c, t, g, unknown or other
  modified_base (425)..(425): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctgggagggtccctgagactctcctgtgtcgcctctggattcaccatcagtgaccactatatggactgggtccgccaggctccgaggggaaggggctgggagtggcttggccgccaagtaaaaacaaagttgaccagctttancanagagtacgcgctctgagaaagcagacttccaccctctacaaaganaatcgtaaacttacgaaacgtaaaccttacgtaatttacgtaatttcgtaggtacgtaaagtacgtaaaccctaaaaccgtaacggaaaaacccggagggaaccgacggggactaagttacggttaatttagttgttagttaagttagtttaatactacgaaggtaacttcgtaccg

SEQ ID NO: 438731 - DNA, 545 bp, Homo sapiens
  misc_feature: GZ8MTXP02GGQGH.44.36.D03.1.454.CMB.2.raw
  modified_base (377)..(377): a, c, t, g, unknown or other
  modified_base (424)..(424): a, c, t, g, unknown or other
  modified_base (460)..(460): a, c, t, g, unknown or other
  modified_base (489)..(489): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccactatatggactgggtcccgccaggctccgaggggaggggctgggagtggctggccgacaagtaaaaacaagttgaccagtctttancacagacgtaccgccgcgtctgtagaaacgccagacttcccaccctntacaaagagatgacttacaaagtactcattgattcngacgaatcgaactaaccgtagaaaaccgnggacacggacagtgtattattgttgttgttagtttactatcgaggtactcgtaccg

SEQ ID NO: 438732 - DNA, 573 bp, Homo sapiens
  misc_feature: GZ8MTXP02INHHR.44.36.D03.1.454.CMB.2.raw
  modified_base (312)..(312): a, c, t, g, unknown or other
  modified_base (362)..(362): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccatgtgaggtgcggctgggtggagtcgtgggggaggcgttggtacgagggcgggggggtccctggagactctcctgtgcagcctctggattcatcttcagtgactatgccatgaactgggtccncaggctccgagggagggctggagtggttcatatgttaatattgactgganactaccacctacgtacgcagtactgtgtagacgggctattaccacctaatccgaaggacaatcgaccaaagactacacgttagtaactcgtaggaaatagaaacacggtcctaggaacggaacggacggaaggaccggtacggactttcgtacctttaccttcgtcggttacggaggtacggtacgtcccggggtacctacggttttcggg

SEQ ID NO: 438733 - DNA, 717 bp, Homo sapiens
  misc_feature: GZ8MTXP02F1O6Q.44.36.D03.1.454.CMB.2.raw
  modified_base (308)..(308): a, c, t, g, unknown or other
  modified_base (379)..(379): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccnccgaggctccgaggggaaggggctgggagtggcttgggccgacaagtaaaaacaagttgccaagtctttanacaacgagacgtaccgccgtcgtcgtagtagaaacgcctaagtaccttacccgaccccttctaacgaaagagtaacttacgtaaacctttaacgaaaacgttaccttacgttaagtttacgtaactttaccgtacgggtaacctaaaacggttaccgtaaaaccgttaaaaccccggtaaaacggggaaaaaaccccgggacggggtaaaacccggaaacgggggtacctaaagtttaacggtttaaacgttttaacggtttcgggttttaggtttaaggttttaacgttttaaagtacggtaacggtaaaacgggttaacctttacgggtaaccccg

SEQ ID NO: 438734 - DNA, 576 bp, Homo sapiens
  misc_feature: GZ8MTXP02GVO4K.44.36.D03.1.454.CMB.2.raw
  modified_base (305)..(305): a, c, t, g, unknown or other
  modified_base (375)..(375): a, c, t, g, unknown or other
  modified_base (427)..(427): a, c, t, g, unknown or other
  modified_base (438)..(438): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaaggtgtccagagtgaagtgcagttggtggagtccgggggagacttggtccagcctggagggtccctgagactctcctgtgtcgctctggattcaccatcagtgaccactatatggactgggtccnccaggctccgaggggaggggctgggagtggcttggccgacaaggtaaaaaccaagttcgaccagctttancaagagacgtaccgccgcgtcgtgagaaacgccaagtacttacccacccctntaacgaaaganatacgtaacttacgaaactactatattacgtattcgtagactaatacgaacctaaaccgaaagaaaaccggacggacgacggactagttagtacttagttgttagttgttaagtttatactagtaacgtactcgtacg

SEQ ID NO: 438735 - DNA, 573 bp, Homo sapiens
  misc_feature: GZ8MTXP02F5WCP.44.36.D03.1.454.CMB.2.raw
  modified_base (207)..(207): a, c, t, g, unknown or other
  modified_base (221)..(221): a, c, t, g, unknown or other
  modified_base (266)..(266): a, c, t, g, unknown or other
  modified_base (289)..(289): a, c, t, g, unknown or other
  modified_base (303)..(303): a, c, t, g, unknown or other
  modified_base (371)..(371): a, c, t, g, unknown or other
  modified_base (387)..(387): a, c, t, g, unknown or other
  modified_base (417)..(417): a, c, t, g, unknown or other
  modified_base (424)..(424): a, c, t, g, unknown or other
  modified_base (549)..(549): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttcctgttgttattttacaaggtgtccagagtgaagtgcagttggnggagtccggggganacttggtccagcctggagggtccctgagactctcctgtgtcgctnggatcaccatcagtgaccatatntggactcgggtccncgaggctccgaggggaagggctgggagtggcgttggccacaaagtaaaaacagtcgaccagtctttancacagacgtacgccgngtctagtaaacgccagtactccacccttanacaaagngatagaacttacaaagaccttcaatttcgaactttcgagacgaaattcggaaaccttaaacgaagaaaacccggagaaccgagggtacaagttacgtaatttacgtgttgttagttcgtttaatntacgaaggtatcgtactaacgggg

SEQ ID NO: 438736 - DNA, 589 bp, Homo sapiens
  misc_feature: GZ8MTXP02JIPKK.44.36.D03.1.454.CMB.2.raw
  modified_base (375)..(375): a, c, t, g, unknown or other
  modified_base (393)..(393): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtcggccccaggggagaccggccaggattaccgtggtgggggcgacggccggttggaggtaaaagtgtacagtggtaccagcagaagccaggccagacccctgtgctggtcatctattatgatgccggccggcctcgagtgactccctgccgcgtcttcccgtcccggctcccaactcgtacgggaaccnccgggcccaccctgaccntacagcgagggtcggacgggccggggatggagggccgactagttacgtgtacgagctggtgggactagtagtaggtagagtcgacgttcccggtaggtacgttcgggcggtacgggaccgaaggccgtacgaccggtccgtcgggtcacggcccgaacggccgtccggccccgttccggtccaccttccgttcccg

SEQ ID NO: 438737 - DNA, 576 bp, Homo sapiens
  misc_feature: GZ8MTXP02FXNLG.44.36.D03.1.454.CMB.2.raw
  modified_base (323)..(323): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctacagtacatctctgaagagctagtttaaccatctaccaagaccacctacaaaggcaggtgtcttagtatcgaccanagtcgaccctgcgacaccgagcacatatactgtgcgagggtaatggacgggaaaagaaacgagtcgttggtttctagttaattataagttctactatcgtaggacgtgtaggggacaaagggacccacggtccaccgtctcccgtacgacgtccttaccgaccgaacgggccctacgttccggtcccttcccccgcggccctcccgtcgcccgtccgacggaacgccaccgtcggcggggcacgacggcccgg

SEQ ID NO: 438738 - DNA, 782 bp, Homo sapiens
  misc_feature: GZ8MTXP02JMHVN.44.36.D03.1.454.CMB.2.raw
  modified_base (209)..(209): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggaggtccgggggagacttggtccagcctgggaggtccctgagactctctgtgtcgctctggattcacatcagtcgaccactatatggactgggtccgcaggctccgaggggaagggctgggagtggcttgggccgacgaagtaaaaaaccaagttcgaccaggtctttagccaacaggtaacgtaccggcgtcgttctaggtacgaaaacgtcccgaaggtactttacccgaacccccttcgtaaccgaaaaggacggtacttacggtaaacccttttacgaaaacggttaaacccttaccttaaacgttttagggtaacttttaccgtaggtaacccgggtaaaatttaccgggaaaaccctttaaaaccccggtaaacgggaaaaaaacccccggggtaacggggaaaacccgaaaccccgggggggtaaacttaaacgggtttaaacgggttttaaacttttaaaacggttttgggtttagggtttttaacggtttttagggttttttaaaactttaaacgttaccgggttaaaacgggggttaaaaccctttcggtttaacccccggg

SEQ ID NO: 438739 - DNA, 707 bp, Homo sapiens
  misc_feature: GZ8MTXP02JBP14.44.36.D03.1.454.CMB.2.raw
  modified_base (188)..(188): a, c, t, g, unknown or other
  modified_base (277)..(277): a, c, t, g, unknown or other
  modified_base (279)..(279): a, c, t, g, unknown or other
  modified_base (447)..(447): a, c, t, g, unknown or other
tcagacagtatatacacgaccggtgctcgatttagctgcgtcacgatctctcttggggagctctgagagcggagccccagccccagaattcccaggtgttttcatttggtgatcagcacagaacacagaggactcaccatggagttcgggctgagcttgggttttccttgttgttattttacaaggtntccagagtgaagtgctagttggtggaggtccgggggatacgttggtccaggcctgggacgggtccctgagactctcctgtgtcgcctcngnttcaccatcagtgaccatatatggacctgggtacccggccgacggacggtacggagggagggcgtggtagtcggtcgtacggaacccgtaaacgtaaagtaaaacaacgtcgtacctacgtcacttaacgacgacgacgtacgtaccgcgtagtaacgtacgtaacgnaaacgtacctaccgccttacctaaccctacgtacgtaaacgtaacggtaaacttacgaaacgttacctaacgtaaacgttacgtaacgtttacgtaacgttaccgttaacgtaccggtaaaaccgttaaaccggtaaaaccgtaaaaaccccggtaacggaaaaacccggaaacggggtaaccgtaaacgggtacgttaacgtttaggtttagtttaagtttaggttacgaaacgttacgtttcgtaacgtaacgtacgg

SEQ ID NO: 438740 - DNA, 699 bp, Homo sapiens
  misc_feature: GZ8MTXP02JRT5V.44.36.D03.1.454.CMB.2.raw
  modified_base (382)..(382): a, c, t, g, unknown or other
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagctgggttttccttgttgttatttacaaggtgtccagagtgaagtgcagttggtggaggtccgggggagacttggtccagcctggagggtccctgagactctcctgtgtcgcctctggattcaccatcagtgaccactatagtggactgggtcccgccgaggctccgaggggaaggggctgggagtggcgttgggccgacaagtaaaaacaagttgccagtctttancacagacgtaccgccgcgtcagtgaaaacgtcccaagtacttcccaacccttctaacaaaggatatcgtaaacctttcgaaaagtaaacccttcgtaaagtttggaaacttttccgaggaaccggttaaaatccgggtaaaaccctttaaacccgtaaaaggggaaaaaaacccccggggtaggggaaaaccccggaacgggggtaaacttaaaggtttacggtttaaaacttttacggtttagggtttaggtttaaggttttacgtttttaaaagtaccgttacggaaacggggtttaaccctttcggtaaccccg

SEQ ID NO: 438741 - DNA, 621 bp, Homo sapiens
  misc_feature: GZ8MTXP02F9TNK.44.36.D03.1.454.CMB.2.raw
  modified_base (308)..(308): a, c, t, g, unknown or other
  modified_base (487)..(487): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcagttggtggaggtccgggggagacgttggtccagccgtggaggtccctgagctctcctgtgtcgcctctggatcaccatcagtgaccactatatggactgggtccncgaggcctccgaggggaaggggctgggagtggcgttggccgacaaagtaaaaacaagttcgaccagtctttagcaacaggacgtaccgccgtcgtcgtagtagaaaacgcccaagtacttacccacccctctacgaaagagatcgaacctttacgaaagtaacctctaatttgatttcnggacgtaaatcgaacctaaaccgtacggaaaaaccggacggaaccgaacgggctaaagttggttaactttaagtttggttagtttaaggtttagttttaactagttaccgtaagggtaaccttcggttaacccg

SEQ ID NO: 438742 - DNA, 550 bp, Homo sapiens
  misc_feature: GZ8MTXP02JHXF3.44.36.D03.1.454.CMB.2.raw
  modified_base (223)..(223): a, c, t, g, unknown or other
  modified_base (278)..(278): a, c, t, g, unknown or other
  modified_base (341)..(341): a, c, t, g, unknown or other
  modified_base (369)..(369): a, c, t, g, unknown or other
  modified_base (411)..(411): a, c, t, g, unknown or other
  modified_base (419)..(419): a, c, t, g, unknown or other
  modified_base (428)..(428): a, c, t, g, unknown or other
  modified_base (485)..(485): a, c, t, g, unknown or other
  modified_base (532)..(532): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagattctctgtgtcgctctggattcaccntcagtcgaccactatatggactgggtccgcaggctccgagggagggctgggagtggctggccncaagtaaaaacagttgccaagtctttancaacagagtaccgcgcgtctgtgaaagccagacttcaccctntacaaganatgaccttnaaagaactcgaattgatttcagcgtaaatggaaccttaaaccgtagaaaaacccggnggaaccacggggacaaagttgtactttagttgtgttgtacgttttanatcgaggtactggtaccc

SEQ ID NO: 438743 - DNA, 622 bp, Homo sapiens
  misc_feature: GZ8MTXP02JF788.44.36.D03.1.454.CMB.2.raw
  modified_base (301)..(301): a, c, t, g, unknown or other
  modified_base (342)..(342): a, c, t, g, unknown or other
  modified_base (370)..(370): a, c, t, g, unknown or other
  modified_base (462)..(462): a, c, t, g, unknown or other
  modified_base (522)..(522): a, c, t, g, unknown or other
  modified_base (579)..(579): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgctctggattcaccatcagtgaccactatatggactgggtccnccaggctccgaggggaaggggctgggagtggcttggccganaagtaaaaacagttcgaccagtctttancaacagcgtacgccgcgtctgtagaaacgcccaaagtacttcccaacccctctacaaagtatactacgaacctttacgaaaagtacccttanatttagatttccgaggaccgtaaaatcggaaacccttaaacccgtaggaaaaaccccggngggaaaccgacgggtactagttagttaagtttagttggttagtttgttacgtttaanacgtaacgaagtactcgaccgtacggtccggggacctaacggg

SEQ ID NO: 438744 - DNA, 537 bp, Homo sapiens
  misc_feature: GZ8MTXP02JZ1RM.44.36.D03.1.454.CMB.2.raw
  modified_base (224)..(224): a, c, t, g, unknown or other
  modified_base (260)..(260): a, c, t, g, unknown or other
  modified_base (373)..(373): a, c, t, g, unknown or other
  modified_base (394)..(394): a, c, t, g, unknown or other
  modified_base (403)..(403): a, c, t, g, unknown or other
  modified_base (420)..(420): a, c, t, g, unknown or other
  modified_base (475)..(475): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggccagcctgggagggtccctgagactctccngtgcgctctggattcaccatcagtgaccactatatggactggggtcccgccaggctccaggggaaggggctgggagtggcttggccgacagtaaaaacagttgccagctttancacagatacgccgcgtctgtnaaagccagnttccaccctctcaaagnatgacttcaaagactcatgattctgcgaatcgaactaaaccgtgaaaaacccggnggacacgggcatagttaatttattgtgtttgtgtttttaactatcaggtaactcggtacccg

SEQ ID NO: 438745 - DNA, 742 bp, Homo sapiens
  misc_feature: GZ8MTXP02GRWX7.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctaacagtacatctctagaagagactaagtttaaccatacctaccgaaggaaccaccctaaccgaaaacggcgagggttgttacctttagtatcgaacccaactagtcggaccctggaccggacaccgaggccaacgtaattacttacgtagtcggaccgtaacggggttaaagtacgggaaaccgggaaaagaaacgtacggtacgtttaggttttaccttagttaaatttaagttaaacgtttacttaaccctagttcgtacgggtaccgttcggttacgggggaaccgaaaacgggggtacccctaccgggttaccctacccgggttccctacccgtacgaccgttcccttaacccgaacccggtaaccggggacccctacggttccccggttcccctttcccccggtcggtccccgtccccgttccgacccgtacccggacggaaccgcccgtaccggtccggacgggggacccaccggacggtccccggg

SEQ ID NO: 438746 - DNA, 650 bp, Homo sapiens
  misc_feature: GZ8MTXP02IM9WU.44.36.D03.1.454.CMB.2.raw
  modified_base (171)..(171): a, c, t, g, unknown or other
  modified_base (263)..(263): a, c, t, g, unknown or other
  modified_base (266)..(266): a, c, t, g, unknown or other
  modified_base (318)..(318): a, c, t, g, unknown or other
  modified_base (324)..(324): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttcgtgtagtnttacaagtgtcagagtgagtgcagtggtggaggtcggggagacgtggtcgagccgtggaggtccgtgagactctcctgtgtcgcctctggtntcncatcagtcgacactatagtgtcgtcggtccgccgacgcgtcggagggagggnggtggnggtggtcgtcggaccgaccgaaacgtaaaacgtaaacgtacgtacgtacgttacttactacgtaacgtaacgtacgtaccgtaccgtccgtacgtacgtacgaacgacgacgtactaccctaccctacctacgaacgagtagtacgtactaacgtaaacgtaactactagttacgtacgttacgtacgtacgtaacgtaacgtaaccgtaaaccgtaaacgtaaaaccggaaacggaacggaacggtacgtaacgttacgttaacgtttacgtttagtttagtttaagtttagtttacgttacgttacgtacgtaacgtacgtacg

SEQ ID NO: 438747 - DNA, 559 bp, Homo sapiens
  misc_feature: GZ8MTXP02HGCGQ.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcttggtacagggcgggggggtccctggagactctcctgtgcagcctctggattcatcttcagtgactatcgccatgaacgtgggtccgccgaggcctccgaggggaacgggcgtgggtaggttgggtttccagttagttgttaatagttgcgtgggagtactacccacctactacgacacgactcgtagtagaacggggcctattccaacctaattcccgaagggtaccaagtcgaccaaagactacactgtaatcgtaggaaactggaacagctagacgacgacgaggacacggctagtcctacttcgtgtcgagtacgacgtcggcctagttcgg

SEQ ID NO: 438748 - DNA, 545 bp, Homo sapiens
  misc_feature: GZ8MTXP02HBR0B.44.36.D03.1.454.CMB.2.raw
  modified_base (216)..(216): a, c, t, g, unknown or other
  modified_base (336)..(336): a, c, t, g, unknown or other
  modified_base (362)..(362): a, c, t, g, unknown or other
  modified_base (472)..(472): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccggggganacttggtccagcctggagggtccctgagactctcctgtgtcgcctctggattcaccatcagtgaccactatatggactgggtccgcaggctccgagggagggctggagtggctggccganaagtaaaacagttcgccagtctttancaacagagtacgccgcgtactgtagaaagcccagacttcccacccgtctacaagagatgacttacaagaactcattgattctgcgaatcgactaaaccgtagaaaaccgngaacgacgggcagtgtattagttgtgttgtctttaagatcgagtaacgtcgaccgtacgtcggggactacggg

SEQ ID NO: 438749 - DNA, 578 bp, Homo sapiens
  misc_feature: GZ8MTXP02GJKCL.44.36.D03.1.454.CMB.2.raw
  modified_base (315)..(315): a, c, t, g, unknown or other
  modified_base (369)..(369): a, c, t, g, unknown or other
  modified_base (475)..(475): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctatttagaaggtgtccactgtgaggtgcggctgggtggagtcgtgggggaggcgttggtacgagggcggggggggtccctggagactctctgtgcagcctctggattcattcttcagtgactatgccatgaacgtcgggtcccncgaggctccgaggggagggctggtagtggttcatatagttaatattgctggganactaccacctactacgcagtactcgtgtacgaaggggccctaattaccacctaattccgagggaacaatcgaccaaagactcactagtactcgaggaaatgaaacngaccgtagaagacggacggaagggaccaacgggtcttacggtaccttacctttcgtaacggtttacggaagtaaggtacgtcccggggtacctacgtttcggg

SEQ ID NO: 438750 - DNA, 556 bp, Homo sapiens
  misc_feature: GZ8MTXP02GCR81.44.36.D03.1.454.CMB.2.raw
  modified_base (223)..(223): a, c, t, g, unknown or other
  modified_base (310)..(310): a, c, t, g, unknown or other
  modified_base (379)..(379): a, c, t, g, unknown or other
  modified_base (429)..(429): a, c, t, g, unknown or other
  modified_base (437)..(437): a, c, t, g, unknown or other
  modified_base (454)..(454): a, c, t, g, unknown or other
  modified_base (463)..(463): a, c, t, g, unknown or other
  modified_base (489)..(489): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctcctgtgtcgcctctggattcaccatcagtgacccactatatggactgggtccnccaggctccgaggggaggggctgggagtggcttggccgacaagtaaaaacaagttcgaccagtctttancaacaggacgtaccgccgcgtctgtagaaacgccaagtacttccaccctntacaaagngatgacttcaaagactnattgattcngcaatcgaacttaaccagaaaaccgngacgacggctagtagttattagttggttacgttgtttatttaatacgtacgaacggtactcgtaccg

SEQ ID NO: 438751 - DNA, 729 bp, Homo sapiens
  misc_feature: GZ8MTXP02JJ5PU.44.36.D03.1.454.CMB.2.raw
  modified_base (223)..(223): a, c, t, g, unknown or other
  modified_base (320)..(320): a, c, t, g, unknown or other
  modified_base (591)..(591): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagcttgggttttcctgttgttatttacaaggtgtccagagtgaagtgcagttggtggaggtccggggganacgttggtccagccgtggacgggtccctgacgctctcctgtgtcgcctctggacttcaccatccagtcgaccactatagtcggacgtcggggtcccnccgaggcctaccggaggggaacggggtctgggagtggccgttggaccgacaaagtaaaaacagttcgacctagtactttagcaacgtagacgtaccgccgtcgtctagtagaaacgcccaagtacttacccaccccttactacgaaaggtacagtacgtaaacctttacgaaaacggtaaaccttcgtaaatttacgggaactttacgtacggacgtaaaacgttacggtaaaccccgtttaaaacccgaacgggtaaaaaaaccccgggnggggaaaacccgtaaccgggggtaccttaaacggttacggtttaaacttttaaacggtttggtttacggttttaaggtttacgtttttaacgtaaacgtttaccggaaaacgggtttaccgtttacgttaaccccggg

SEQ ID NO: 438752 - DNA, 660 bp, Homo sapiens
  misc_feature: GZ8MTXP02F6HDO.44.36.D03.1.454.CMB.2.raw
  modified_base (204)..(204): a, c, t, g, unknown or other
  modified_base (312)..(312): a, c, t, g, unknown or other
  modified_base (325)..(325): a, c, t, g, unknown or other
  modified_base (364)..(364): a, c, t, g, unknown or other
tcagacagtatatacacgaccggtgctcgatttagctgcgtcacgatctctcttggggttcaactgtggtagagaagacaggattcaggacaatctccagcatggccggcttccctctcctcctcaccctcctcactcactgtgcagggtcctgggcccagtctgtgctgactcagccatcctcagcgtctcgggacccccggnagacggtcacgattcttttgttctggaagttaggtccaaacatacgggaaagttaattacgtatactggtatcggactaatcacaggacgccgtccccagaccccctnatactagtagganaactcgacggccgccctcggtacgggtccctagaccgtnttccctctcgcctacagtcctcgcctacctcaccgtcccctcccgtacgacctatcgacggtcggtcccgtcccggtacggaggtacgtcggacggtcttagttatttacgtttcgtcggtcggtccgggttcgttagggtacttacgaaccgtacgttaccggtaggtacggtcggtacgtcgtacgttacggtccggggacgggtaacggaaaccgtaacggtaccgtaccggtacccgtaacgtaacggtccgaaccggtacccgaacggtcccgtacccggtaccccgtcgg

SEQ ID NO: 438753 - DNA, 621 bp, Homo sapiens
  misc_feature: GZ8MTXP02HZO33.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaaatcctacagtacatctctgaagagcagtttaaccatctaccaaggacacctaccaaaaggcaggtgtctttagtatgaccaacatcggacctgcggacaccaggcacatattactgtgcgaacgggtaatggaacggggaaaagaaacagacgttaggtttactagttattaataagttactttaacctatcgtaggtacgtcgtacgggggacgaaaacggggacccgtacggtaccgtaacccggtcctacccgttacacggtccttacccgaacccgaacgggacccctaacgttcccgggtccctttcccccgtcggcccggtcccctcgcctcccgaggaacgccaccgtccggcgggggaccacgcgcccggg

SEQ ID NO: 438754 - DNA, 530 bp, Homo sapiens
  misc_feature: GZ8MTXP02J05C8.44.36.D03.1.454.CMB.2.raw
  modified_base (191)..(191): a, c, t, g, unknown or other
  modified_base (225)..(225): a, c, t, g, unknown or other
  modified_base (437)..(437): a, c, t, g, unknown or other
  modified_base (449)..(449): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaatcatcatctatgaggtcctataagcgccctgtaggggtttctaactcgcttcactgccttcagtccggacaacacgcctccctgacaatctctcgggctccagctggaggacgtaggctagattattagttgttgctacagtntgtttcggcacnttccattatcgtcgttacgggagttacgggactaacggtccaacccgttctaaggtacacgcccgaaagcccaacccatcg

SEQ ID NO: 438755 - DNA, 559 bp, Homo sapiens
  misc_feature: GZ8MTXP02ISPOR.44.36.D03.1.454.CMB.2.raw
  modified_base (221)..(221): a, c, t, g, unknown or other
  modified_base (303)..(303): a, c, t, g, unknown or other
  modified_base (337)..(337): a, c, t, g, unknown or other
  modified_base (364)..(364): a, c, t, g, unknown or other
  modified_base (400)..(400): a, c, t, g, unknown or other
  modified_base (419)..(419): a, c, t, g, unknown or other
  modified_base (441)..(441): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttcctgttgttatttacaaggtgtcagagtgaagtgcagttggtggagtccggggganacttgggtccagcctgggagggtccctgagctctctgtgtcgctctgattcaccatcagtcgaccatatatggactgggccncaggctccgaggggagggctggagtggctggccncaagtaaaaacagtcgccagtctttancacagacgtaccgccgcgtctagtagaaacgccaancttccacccttcacaaagngattgaacttcaaagaaccttntattgattcgagacgtaatacgaactaaccgagaaaaccggcggaaccgacggactagttagttaacttagttgttagtttaagttgtttaactacgtagtaacgtacgttcgtaccg

SEQ ID NO: 438756 - DNA, 608 bp, Homo sapiens
  misc_feature: GZ8MTXP02H1LAA.44.36.D03.1.454.CMB.2.raw
  modified_base (308)..(308): a, c, t, g, unknown or other
  modified_base (378)..(378): a, c, t, g, unknown or other
  modified_base (382)..(382): a, c, t, g, unknown or other
  modified_base (579)..(579): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgcgcctctggattcaccatcagtgaccatatatggactgggtccnccaggcctccgaggggagggctggagtggctggccagaaagtaaaaacaagttcgacctagtacctttanccanaacgagtaccgccgcgttactgtagaaacgccaagtacttcccaccctctacaagagatagtaaccttcaaaagtaactctaatttgaatttccgtagacgtaatacgaacttaaacccgaagaaaacccggaggaaacccgaaggggtcctaaagttacgtttatttaacgtttggttagtttggttaattttaanacgttacgaacggtaacttcggtaccccg

SEQ ID NO: 438757 - DNA, 707 bp, Homo sapiens
  misc_feature: GZ8MTXP02JMDP5.44.36.D03.1.454.CMB.2.raw
  modified_base (398)..(398): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaaggtgtccagagtgaagtgcagttggtggaggtccgggggagacttggtccagccgtgggacgggtccctgagactctctgtgtcgcctctggattcaccatcagtcgaccactatatggactcgggtccgcaggcctaccgaggggaagggctgggagtggctcggcgacaagtaaaaacaagttcgaccagtctttagcaactagacgtacgccgngtcagtgaaaacgcccaagtacttcccaccccttacaacgaaaggtacgacgttacgtaaccttacgaaaacgtaaccttagtaactttaggtaacctttccgtacggaaacgttaaacgttaccggtaaaacccgtttaaaaccccggaaaacgggaaaaaaccccgggtacggggtaaaacccggtaaccgggggtaaccttaaaggtttacggtttaaacgttttaacgtttccgggttaggttttaaggtttaaccgtttttaaataccggttaacggtaaacggtaacctttcgggtaaccccg

SEQ ID NO: 438758 - DNA, 640 bp, Homo sapiens
  misc_feature: GZ8MTXP02GDF1X.44.36.D03.1.454.CMB.2.raw
  modified_base (309)..(309): a, c, t, g, unknown or other
  modified_base (376)..(376): a, c, t, g, unknown or other
  modified_base (543)..(543): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactggggtccnccaggctaccgaggggagggctggagtggcttggccgacaagtaaaaacaagttgaccagtctttancacagacgtaccgccgcgtctagtagaaaacgcccaagtactttcccaaccccgtctaccaaaaggcgaattcgtaaacctttacgaaaacgtaaaccttcaatttggaaactttccgagaccgtaaattacggtaaacccttaaaccgtacgggaaaaaaccccgngggaaacccgtaacgggggcctaaagttcggttaactttacgttgtttagtttaagttagttttaactagttaccgaaaggtacttcggtaaccccg

SEQ ID NO: 438759 - DNA, 550 bp, Homo sapiens
  misc_feature: GZ8MTXP02I1MK1.44.36.D03.1.454.CMB.2.raw
  modified_base (312)..(312): a, c, t, g, unknown or other
  modified_base (352)..(352): a, c, t, g, unknown or other
  modified_base (377)..(377): a, c, t, g, unknown or other
  modified_base (525)..(525): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccaggaaggccctggagtggcttgcacacatcttctcgaatgacgaaaatcctacagtacatctctgaagagcagtttaaccatctccaaggcacctccaaaaggcaggtggtcttagtatnaccaacatcggacccctgcggacaccaggcacatattacngtgcacggtaatgcggaaagaaacngactgtttactgtattataagtctaccatctgacgtcgtgggcaaagggcccagccgaccgtctccgtcacgcttccaccgtaacggcccaacgtccgtaccgttccccctacggtccggaccctcgtctccccgagaacgcgacccncgtcgggggccgacaccggtcccgg

SEQ ID NO: 438760 - DNA, 553 bp, Homo sapiens
  misc_feature: GZ8MTXP02FUPP6.44.36.D03.1.454.CMB.2.raw
  modified_base (371)..(371): a, c, t, g, unknown or other
  modified_base (374)..(374): a, c, t, g, unknown or other
  modified_base (540)..(540): a, c, t, g, unknown or other
tcagacagtatatacacgaccggtgctcgatttagctgcgtcacgatctctcttgggagctctgagagcggagccccagccccagaattcccaggtgttttcatttggtgatcagcactgaacacagaggactcaccatggagttcgggctgagcgtgggttttcctgtgttattttacaaggtgtcagagtgaagtgcagttggtggagtccgggggagacttggtccagcctggagggtccctgagactctcctgtgtcgcctctggattcaccatcagtgacccatatatggactggggtccgccaggctccaggggaaggggctgggagtggcttggccgccagtaaaaacaagttgccagctttancanagagtacgcgcgtctgtagaaacgccaagtatacaccctacctacaagagagtagtacttacaaacgaactactattagtattactcgacgaatacgaactaaacctaacgaaaaccggaaacggaacgacggacgatagtattattgttgttgttgtttatatanacgaactacgtcg

SEQ ID NO: 438761 - DNA, 722 bp, Homo sapiens
  misc_feature: GZ8MTXP02HJYVW.44.36.D03.1.454.CMB.2.raw
  modified_base (380)..(380): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtgggagggtccctgagactctcctgtgtcgcctctggattcaccatcagtgaccactatatggactgggtccgccaggcctccgaggggaaggggctgggagtggcgttggccgacgaaagtaaaaacaagttcgaccagtctttancacagcgtaccgcgtcgtctagtagaaacgcccaagtacttcccaacccttcgtacaaagagtacttacgtaacctttacgaaaacgtaacctttacaagttttacggaactttttcgacggtaaccgtaaaattccggaaaacccttaaaccccggtaaagggaaaaaacccccggaggggaaacccgaaaccgggggtacttaaacggttaggtttaaattttaaacggtttgggtttaggttttagtttaccgtttttaaataagttaaccgtaaaaggggttaaacccttcggggtaacccctacgggggttacgggggaccccgtaaaacccggggg

SEQ ID NO: 438762 - DNA, 685 bp, Homo sapiens
  misc_feature: GZ8MTXP02JNS7H.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgttgtatttacaaggtgtccagagtgaagtgcagttggtggagtccgggggagacttggtccagcctggagggtccctgagactctcctgtgtcgcctctggatcaccatcagtcgaccatatagtggactcggggtcccgaccgaggccgtaccggagggggaacggggtcgtaggggaggttcgggcgtttcggggccgaccgtaaagtaaaaaaccgtaaaggttcggacctaagtccttttacacgaacgtaacgtacgtaccgcccgtcgtcgtagtaacgaaaccgtccaagtaccttacccacccgtactaacgaaagtaagtactacgtaaaccttacgaaacgttaccttactaagtttacgtactttcgtacgtacgtaacgtaacgtaaccgtaaaccgtaaacgtaaaaccggaacggaacggacggtacgtaagttaacgttagtttacgtttagtttagtttaagtttagtttacgttacgttacgtaacggtaacgtacgtaccg

SEQ ID NO: 438763 - DNA, 598 bp, Homo sapiens
  misc_feature: GZ8MTXP02GHURO.44.36.D03.1.454.CMB.2.raw
  modified_base (318)..(318): a, c, t, g, unknown or other
  modified_base (397)..(397): a, c, t, g, unknown or other
  modified_base (449)..(449): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccgggggagacgttgggtccaggccgtgggacgggtccctggagactctcctgtgtcgcctctggattcaccatcagtcaccatatagtggacgtgggtcccncgaggcctaccggaggggacggggctgggagtggcttggggccgacgaaagtaaaaactaggttcgacctagtctttancaacgagacgtaccgccgcgtctagtagaaacgccaagtcttacccaccctntacgaagagatcgtaaacttacgaaagtacctntattagtattcgtgactaatacgaaacctaaacgtaacggaaaacgacggacgacgggatagtagttattagttggttgttaagtttacgtttatactacgaggtaccttgtaccg

SEQ ID NO: 438764 - DNA, 546 bp, Homo sapiens
  misc_feature: GZ8MTXP02JLSKZ.44.36.D03.1.454.CMB.2.raw
  modified_base (375)..(375): a, c, t, g, unknown or other
  modified_base (412)..(412): a, c, t, g, unknown or other
  modified_base (419)..(419): a, c, t, g, unknown or other
  modified_base (422)..(422): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttctgtagtatttacaagtgtcagagtgaagtgcaggttggtggagtccgggggagacgttggtccagcctggagggtccctgagactctcctgtgtcgcctgtggattcaccatcagtcgaccatatatggactcgggtccgccaggcctccgaggggaaggggctgggagtggcttggccgaccaagtaaaaacaagttcgcctagctttancagagacgcgcgctctagagaacgcagtctccacctnacgaagntanagtactacaagactatatatatactagacgatacgactaacgtaacgaaacgaacgacgacgacgtagtacgtacgttagttgttagttaagttagttagttactacgtacgtacgtacgtacg

SEQ ID NO: 438765 - DNA, 608 bp, Homo sapiens
  misc_feature: GZ8MTXP02H7H73.44.36.D03.1.454.CMB.2.raw
  modified_base (536)..(536): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggttgtccagagtgaagtgcaggtttggtgggaggtccgggggagacttgggtccagccgtgggagggtccctgagactctcctgtgtcgcctctggattcaccatcagtgaccactatatggactgggtcccgccgaggcctccggaaggggaggggctgggagtggcgttgggccgacaaagtaaaaacaaagttcgccagtctttatcacagacgtaccgcgtcgtctgtagaaacgcccagtacttccacccttctacgaaagacgatagtaaaccttacaaaagtaacttcgtaatttgactttcgtaggacgtaagtacgtaacctaaaccgtaggaaaaacccggnggaaacgacgggactaagtagttaattagtttgttgtttgtttatttatattcgaaggtacttacggtcccg

SEQ ID NO: 438766 - DNA, 559 bp, Homo sapiens
  misc_feature: GZ8MTXP02H6E9H.44.36.D03.1.454.CMB.2.raw
  modified_base (222)..(222): a, c, t, g, unknown or other
  modified_base (304)..(304): a, c, t, g, unknown or other
  modified_base (338)..(338): a, c, t, g, unknown or other
  modified_base (366)..(366): a, c, t, g, unknown or other
  modified_base (409)..(409): a, c, t, g, unknown or other
  modified_base (435)..(435): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggatttcgggctgagctgggttttccttgttgttattttacaaggtgtccagagtgaagtgcagttggtggagtccggggganacttggtccagcctggagggtccctgagactctcctgtgtcgcctctggattcaccatcagtgaccatatatggactggccnccaggctcgagggagggctggagtggctggccgnaaggtaaaaacaagttgcctagctttancacagagtacgccgagtctgtagaaagccagacttcacccttnacaagagatagacttacaagaacttntattagattcgagacgtaatacgtaacctaaacgtaacgaaaaccgacggaacgacgggactaagtagttattacgtttgtagtttaagttagtttaatacgtagtaacggtacttacgtaccg

SEQ ID NO: 438767 - DNA, 691 bp, Homo sapiens
  misc_feature: GZ8MTXP02I26RC.44.36.D03.1.454.CMB.2.raw
  modified_base (482)..(482): a, c, t, g, unknown or other
  modified_base (523)..(523): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagtacgttggtccagccgtgggacgggtccctgagactctcctgtgtcgcctcgtggattcaccatcagtcgaccactatagtggactcggggtcccgccgaggcctaccggaagggggaacggggctaggggagtcgggtcgttcgggaccgacaaaagtaaaaactaaaggttcgaccctaagttctttagaccaacgaggtacgtaccgccgtacgttctaggtagaaaacgcccaagtacttcccaaccccttntaacgaaagatactcgtaaaccttcgaaaagtaaccctttntaagttcgtaactttcgacggtaacgtaaataccggtaaaccttaaaccggaaaggaaaaacccggagggaaccgaacggggtacttaaaggtttacgtttaaagtttacgtttggttacgttttgttagttttaatacgtacggtaaacggttaccttcggtacccg

SEQ ID NO: 438768 - DNA, 594 bp, Homo sapiens
  misc_feature: GZ8MTXP02IIZ8V.44.36.D03.1.454.CMB.2.raw
  modified_base (222)..(222): a, c, t, g, unknown or other
  modified_base (268)..(268): a, c, t, g, unknown or other
  modified_base (307)..(307): a, c, t, g, unknown or other
  modified_base (440)..(440): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccggggganacttggtccagcctgggagggtccctgagctctcctgtgtcgcctnggattcaccatcagtcgaccactatatggactgggtccncaggctccgagggagggctggagtggctggccgacaaagtaaaacaaagttcgacctagtctttagcaacaggtacgtaccggccgcggttctagtagaaacgcccaagactttccacccctctacaaagganatcgtaaacttcaaaagtacttcaatttgatttcgagacgtaaatcgaaccttaaaccgagaaaaacccgaggaaaccacggggactaagtagttaattaagtttggtagttaagtacgtttttaaagtacttacgaacggtaacgtcgtaccg

SEQ ID NO: 438769 - DNA, 603 bp, Homo sapiens
  misc_feature: GZ8MTXP02HH1E2.44.36.D03.1.454.CMB.2.raw
  modified_base (326)..(326): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaagccctggagtggcttgcacacatcttctcgaatgaacgaaaatcctaacagtacatctctagaagagcaagtttaacccatctaccaagaccacctaccaaaaggcaggtgtcttagtatgaccaanatcggaccctgcggacaccgagcacatatactgtgacacggggtaatggacgggaaaagaaacgagtcgttggtttcttagtatttaagtaagttactttactattcgtagggacgttcgtagggggacgtaaacggggacctaagtgggtaccaccgttcctccgtacacgtccttacccaccgaacgggccctacgtcccggttccctacccccgtggcccgtcccgtcgccctccgaaggacgcccgaccgtccggtcggggaccacgaccggg

SEQ ID NO: 438770 - DNA, 530 bp, Homo sapiens
  misc_feature: GZ8MTXP02H2B6V.44.36.D03.1.454.CMB.2.raw
  modified_base (327)..(327): a, c, t, g, unknown or other
  modified_base (367)..(367): a, c, t, g, unknown or other
  modified_base (439)..(439): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctgggacccccgggcagagggtcatcatctcttgttctggaagcagttccaacatcggccctaattctgtatatggtacagcaagtcccaggaacgcccccaaactccctcatctataggactaatcagcggcccctnacggggtcccctgaccgattctcctggctcaagtctggcncctcacgccctccctggccagtcactgggctccaggctgagatgagggtgattattatcgcagtcctatganagcagcctgagttgggttgggtgttcgggacgggagggaccaaagctcggacccgtcgtgggcacgcccgaaggcctcgccccctcggtcc

SEQ ID NO: 438771 - DNA, 571 bp, Homo sapiens
  misc_feature: GZ8MTXP02FTDMN.44.36.D03.1.454.CMB.2.raw
  modified_base (340)..(340): a, c, t, g, unknown or other
  modified_base (419)..(419): a, c, t, g, unknown or other
  modified_base (478)..(478): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactggtccgcaggctccgaggggaagggctgggagtggcttggccganaagtaaaaacaagttcgaccagctttacacagacgtacgccgcgtctgtacgaaagccagattccaccctctacaaganatgacttcaaagtactcattgattcgtgacgtaatcgaacctaaacgtagaaaacccgnggaacgacgggataagttgtattagttgttagtttgttatttaactagtaacgaaggtaacttcggtaccacggtcgggggaccctaacgggg

SEQ ID NO: 438772 - DNA, 618 bp, Homo sapiens
  misc_feature: GZ8MTXP02GOQ66.44.36.D03.1.454.CMB.2.raw
  modified_base (223)..(223): a, c, t, g, unknown or other
  modified_base (387)..(387): a, c, t, g, unknown or other
  modified_base (477)..(477): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtcgaccactatatcggactcgggtcccgccaggcctccgaaggggaagggctgggagtggcttgggaccgacaaagtaaaaaacaagttcgaccagtctttancaacagacgtaccgcccgcgttctagtagaaaacgcccaaggtacttacccacccctctacaaagagatcgaacttacgaaagtaacctnattagacttcgtagacgtaatacgaacctaaaccgtaagaaaaacccgtaggaacgacgggactaagttacgttaattaacgtttggttagtttaagttacgttttaaagtacgttacgtaacggtaacttcggtaacccg

SEQ ID NO: 438773 - DNA, 604 bp, Homo sapiens
  misc_feature: GZ8MTXP02IGOFM.44.36.D03.1.454.CMB.2.raw
  modified_base (271)..(271): a, c, t, g, unknown or other
  modified_base (307)..(307): a, c, t, g, unknown or other
  modified_base (374)..(374): a, c, t, g, unknown or other
  modified_base (379)..(379): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcttgttgttattttacaaggtgtccagagtgaagtgcagttggtggagtccgggggagacgttgggtccagcctgggagggtccctgagactctcctgtgtcgcctnggattcaccatcagtgaccatatatggactggtccnccaggctcgagggagggctggagtggcttgggccgacaaagtaaaaacaagttcgacctagctttanacaanacgtacgtaccgccgctacgtgtaagaaacgcagtacttacccacctacacgaaagatatacgaacttacaaactaacttactaattgacttcgtagaacgtaaagtacgtaaaccttaaaccgaaacggaaaaaccggacggaacgacgggactaagttacgttaatttacgtttagtagtttaacgttagtttaactacgtacgtacggtaacttcggtaccg

SEQ ID NO: 438774 - DNA, 505 bp, Homo sapiens
  misc_feature: GZ8MTXP02H4PCJ.44.36.D03.1.454.CMB.2.raw
  modified_base (308)..(308): a, c, t, g, unknown or other
  modified_base (383)..(383): a, c, t, g, unknown or other
  modified_base (444)..(444): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttggtacgaggcgggggggtccctgagactctcctgtgcagcctctggattcatcttcagtgactatgccatgaactgggtccncaggctccgagggagggctggagtgggtttccatatgttaatattgctgggagataccacctactacgcagactngtagagggccgattcaccatccgaggacatgaccaagactcactgtatcagaaatgaaacngcctagagacgagacgacacggctcgcttacttctgttcgagacgagtcgggccagttcgg

SEQ ID NO: 438775 - DNA, 571 bp, Homo sapiens
  misc_feature: GZ8MTXP02J3LPC.44.36.D03.1.454.CMB.2.raw
  modified_base (224)..(224): a, c, t, g, unknown or other
  modified_base (366)..(366): a, c, t, g, unknown or other
  modified_base (378)..(378): a, c, t, g, unknown or other
  modified_base (411)..(411): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccggggganacgttggtccagcctggagggtccctgagactctcctgtgtcgcctctggattcaccatcagtcgaccactatatggacgtgggtcccgcaggcctcggagggagggctggagtggcgtggccgacaaagtaaaaacagttncctagtctttanctaacagacgtacgccgtcgtctgtaacgaaanccagtacttccacccttcacaagaaggtatagtacgttacaagtaaaactctattagtactctgacaagtagaacctaacgtaaacgaaaacggacgacgacggacgtactagtattattgttagtgtttagtttatactacgtacggtaactcgtaccg

SEQ ID NO: 438776 - DNA, 594 bp, Homo sapiens
  misc_feature: GZ8MTXP02GUI1W.44.36.D03.1.454.CMB.2.raw
  modified_base (392)..(392): a, c, t, g, unknown or other
  modified_base (489)..(489): a, c, t, g, unknown or other
tcagacagtatatacacgaccggtgctcgatttagctgcgtcacgatctctcttggggagctctgagagcggagccccagcccccagaattcccaggtgttttcatttggtgatcagcactgaacacagaggactcaccatggagttcgggctgagctgggttttccttgttgttattttacaaggtgtccagagtgaagtgcagttggtgggagtccgggggagacttggtccagccgtggacgggtccctgagactctcctgtgtcgcctctggattcaccatcagtgaccactatatggacgtcgggtcccgccaggcctccgaggggaacggggctgggagtcggcttgggccgaccaaaggtaaaaacaaagttgaccagtctttancacagacgtaccgccgacgtctagtagaaacgcccaagactttcccaccccttctaacgaaagagatgtaaccttacaaagtactctattagattcngacgaatcgaactaaccgtaaggaaaacccgaggaaacgacgggtacaagttagttaatttagttgttagttggttatttaatacgtacaaggtactcgtacccg

SEQ ID NO: 438777 - DNA, 574 bp, Homo sapiens
  misc_feature: GZ8MTXP02GBPB2.44.36.D03.1.454.CMB.2.raw
  modified_base (301)..(301): a, c, t, g, unknown or other
  modified_base (340)..(340): a, c, t, g, unknown or other
  modified_base (371)..(371): a, c, t, g, unknown or other
  modified_base (444)..(444): a, c, t, g, unknown or other
  modified_base (475)..(475): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgcctctggattcaccatcagtgaccactatatggactgggtccnccaggctccaggggaaggggctggagtggcttgggccgnagtaaaacaagttcgccagctttatcacagngtacgccgcgtctgtagaaagccagattccaccctctacaagagatgacttcaaagaactcaattgaatttcngacgaaatgaacctaaccgtgaaaaaccggngaaccgacggggctaagtgtaattagttggtgtttgttacgtttaattagtaaccgtaagggaacttcgtacccgacgtcgggggaccctaaaccgggg

SEQ ID NO: 438778 - DNA, 551 bp, Homo sapiens
  misc_feature: GZ8MTXP02FLSQG.44.36.D03.1.454.CMB.2.raw
  modified_base (372)..(372): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaaggggctgggagtggcttggccgcaagtaaaacaagttgccagctttancacagagtacgcgctctgtgaaagccagattccaccctctacaagagatagacttacaaagtactcattgattctagcgtaattgaacctaaaccgtagaaaaacccggaggaaccacggggacagtagttaatttagttgttgttgttagtttactagtctaagggtaactgtacccg

SEQ ID NO: 438779 - DNA, 613 bp, Homo sapiens
  misc_feature: GZ8MTXP02F9UQI.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcagggcagagtcaccatgaccagggacacgtccacgagcacagcctacatggaactgagcagtcagagatcctgaggacatagatgtgtactactgtgcgagaccggtagaggacaaagacgaaagaaaagtaagtttacgtttagaacgtacgtggggaccgaacggggtaaacccgtggtaccgaacccggttcctacccttaccgacgccccgtacccgaacccgaacggggaccccaacgttcccggtcccgtttccccccgtcgggcccctacccccgttccctacccgaaacgaccggacccaacccgtcggtcgggggacccaaccggaccggcccgggtaccccgtcggggtccgttccggg

SEQ ID NO: 438780 - DNA, 611 bp, Homo sapiens
  misc_feature: GZ8MTXP02IVSX8.44.36.D03.1.454.CMB.2.raw
  modified_base (485)..(485): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaaggtgtccagagtgaagtgcagttggtggaggtccgggggagtacttggtccagccgtggagggtccctgagactctcctgtgtcgcctctggattcaccatcagtcgaccactatagtggacgtgggtcccgccgaggcctccggaggggaacggggctgggaggtggcgttggggcccgacgaaagtaaaaaaccaaaggtttcgaccctaaggttctttatcaacgagacgtaccgccgtcgtctggtagaaacgccagactttcccgaccctctacaagagatgacttacaaagaactnattgactttcgagtacgtaaatacgtaacctaaaccgtagaaaaacccggaggaaccgacgggctaagttgttaatttagttgtttagtttgttagtttattagcgtaacggtaacttcgtacccg

SEQ ID NO: 438781 - DNA, 701 bp, Homo sapiens
  misc_feature: GZ8MTXP02GXLV0.44.36.D03.1.454.CMB.2.raw
  modified_base (269)..(269): a, c, t, g, unknown or other
  modified_base (397)..(397): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccagccgtgggacggtccctgagactctcctgtgtcgcctntggattcaccatcagtcgaccatatagtcggactgggtcccgccagggcctaccgaagggggaaggggctggggagtcgggcttgggcccgacaaagtaaaaaactaaggttccgacctagtctttancaacagacgtaccgccgtcgtctaggtaacgaaaacgcccgtaaagtactttacccaaccccttactacgaaaaggaacgtattacggaaacctttacgaaaaacgtaaccttactaaagtttaggtaacttttccgagggtaaccgtaaaataccgtaaaacccttaaaaccgtaaacggaaaaaaccccggaggaaaccgacggggactaagttagttatttaagtggttagtttagttagtttaatagtaaccgtaagggtaacttcggacccgtacgggtcgggggaccctaaacggggg

SEQ ID NO: 438782 - DNA, 645 bp, Homo sapiens
  misc_feature: GZ8MTXP02IK4SG.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaacgaaaaactccctaacagtacatctctagaaagagactaagtttaaaccatacctaccaaggaccaacctaaccaaaaggcaggtgttactttagatacgaaccaaacatacggaccctgacggacaccgagcaactatattactgtgaccgtaaggtaaagtaggaacgggaaaagaaactagtacgttggtttactagttaattaattaaagttccttaacctattacgtacggtacgtcggtaggggaaaccgtaaacggggaccctacgggtcccaaccgttcctccgtacgacgtcctacccgaaccgacgggccctaacgtcccggtcccttcccccgtcgcccgtccctcgccctacgacggaaccgccacccgtcggaccggggcacgcggcccgg

SEQ ID NO: 438783 - DNA, 544 bp, Homo sapiens
  misc_feature: GZ8MTXP02FSU4D.44.36.D03.1.454.CMB.2.raw
  modified_base (223)..(223): a, c, t, g, unknown or other
  modified_base (379)..(379): a, c, t, g, unknown or other
  modified_base (458)..(458): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccggggganacttggtccagcctgggagggtccctgagactctcctgtgtcgcctctggattcaccatcagtgaccactatatggactgggtccgcaggctccgaggggaaggggctgggagtggcttcgggccgccaagtaaaaaccaaagttgccagctttancacagagtacgcgcgtctgtagaaagccaagacttccacccctctacaagagatgacttacaaagactcattgattcgngacgaatcgaacctaaactagaaaaaccgaggacgacgggacagtagtattatgttgttgttgtttatatcgaggtaactgtaccg

SEQ ID NO: 438784 - DNA, 532 bp, Homo sapiens
  misc_feature: GZ8MTXP02JY91K.44.36.D03.1.454.CMB.2.raw
  modified_base (367)..(367): a, c, t, g, unknown or other
  modified_base (441)..(441): a, c, t, g, unknown or other
  modified_base (451)..(451): a, c, t, g, unknown or other
  modified_base (476)..(476): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtccgcctctggattcaccatcagtgaccactatatggactgggtccgcaggctcgagggagggctggagtggctggccgcaagtaaaacaagttgccagctttancaacagagtacgccgcgtctgtagaaacgcccaagacttcccaccctctacaagagatgaacttcaaagtactnattcgattcngcaatgaacctaactagaaaaccgngacgacgggcagtgtattagttgtgttgttagtttactagtcgaagtactgtaccg

SEQ ID NO: 438785 - DNA, 618 bp, Homo sapiens
  misc_feature: GZ8MTXP02GSSNO.44.36.D03.1.454.CMB.2.raw
  modified_base (225)..(225): a, c, t, g, unknown or other
  modified_base (271)..(271): a, c, t, g, unknown or other
  modified_base (315)..(315): a, c, t, g, unknown or other
  modified_base (428)..(428): a, c, t, g, unknown or other
  modified_base (469)..(469): a, c, t, g, unknown or other
  modified_base (479)..(479): a, c, t, g, unknown or other
  modified_base (490)..(490): a, c, t, g, unknown or other
  modified_base (539)..(539): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacttggtccagccgtggagggtccctgagctctctgtgtcgcctcnggattcaccatccagtcgaccactatagtggacgtcggggtccnccgaggcctaccggaggggaacggggctggggagtgggtcgttgggcccgacgtaaaaggtaaaaaacaaggttcgacccaagttctttagaccaagacggacgtaccgccgngttctgtagaaacgccagacttcccaccctctacaaagganatgaacttanaaagtaccttnaatttgattcgtgacgtaatcggaaacctaaaccgtaaggaaaacccgnggaaccgacgggactaagttgttaattagttgttagttaagttacgtttaatactacgtaaggtaacttcggtaacccg

SEQ ID NO: 438786 - DNA, 614 bp, Homo sapiens
  misc_feature: GZ8MTXP02J3OFI.44.36.D03.1.454.CMB.2.raw
  modified_base (243)..(243): a, c, t, g, unknown or other
  modified_base (273)..(273): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcatcaccatctcctgcacgtgggtccagcaatgacagttgganatataaccttgtctcctgtactcaacaacntccaggaccaaacgcccccaaatctaattacttttgatccagtgagccggccgtctagggttctttctaactcgtcttctcgtcggcttaccagtctcggccctacgacccggcccttcccgtgtccgacttccgtcgtcggggtcctcccgggcctacgggacgggacgacgggtctaggtaacttagtttaccgtcggtacccggtctaccgttaactttacctaaacgtttccgttagacggttacggtttggggtcggtttcgggacggggtacggtactccgaccgttcgaacccgttcgtaacggtcgacgcccgaacggtccctccgtcccccg

SEQ ID NO: 438787 - DNA, 593 bp, Homo sapiens
  misc_feature: GZ8MTXP02F8WVH.44.36.D03.1.454.CMB.2.raw
  modified_base (386)..(386): a, c, t, g, unknown or other
  modified_base (439)..(439): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgctctggattcaccatcagtcgaccactatatcggacgtcgggtcccgcgaggctaccggaggggaaggggctgggagtggctgggccgacaagtaaaaacaaggttcgaccagtctttancaacagacgtacgccgtacgtctagtagaaacgccaagtacttccaacccctntacgaaagacgatacgtacttacgaaagtacttcaatttgaactttcaggactaaattcggaaacctaaaccgtaaggaaaacccggaggacccgaagggctagtgttactttagttgttagttgttagtttatcttacgaaggtactgtaccg

SEQ ID NO: 438788 - DNA, 588 bp, Homo sapiens
  misc_feature: GZ8MTXP02HHW4D.44.36.D03.1.454.CMB.2.raw
  modified_base (307)..(307): a, c, t, g, unknown or other
  modified_base (346)..(346): a, c, t, g, unknown or other
  modified_base (373)..(373): a, c, t, g, unknown or other
  modified_base (376)..(376): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccatatatggactgggtccnccaggctccgaggggaggggctggaggggtgcttggccncaagtaaaaacaagttgccagctttancanagacgtaccgcgcgtctgtagaaacgcagtacttccaccctctacaaagagatacgtacttacaaagtacttatatttagtaacttcgtagacgtaaatacgaaaccttaaaccgaaggaaaaacccggaggaaccgacgggactaagttagttactttagtttggttagtttaaggttatttaactagtacgtaacggtaactcgtacccg

SEQ ID NO: 438789 - DNA, 522 bp, Homo sapiens
  misc_feature: GZ8MTXP02JWVAC.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctgggtggagtcgtgggggagcttggtacgaggcgggggggtccctggagactctcctgtgcagcctctggattcatcttcagtgactatgccatgaactggtccgcaggctccgagggagggctggagtggttccatatgttaatattgctggagactaccactactacgcagactcgtgtagaacgggccattcaaccaattcccgaagggaccaagtcgaccaaagactcactgtatcgtaggaaatgaacagcctagagagacgaggacacggctcgtctacttcgtgttacgagagacgtcgggacctagttcgg

SEQ ID NO: 438790 - DNA, 751 bp, Homo sapiens
  misc_feature: GZ8MTXP02IQNLB.44.36.D03.1.454.CMB.2.raw
  modified_base (422)..(422): a, c, t, g, unknown or other
  modified_base (442)..(442): a, c, t, g, unknown or other
  modified_base (456)..(456): a, c, t, g, unknown or other
  modified_base (502)..(502): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagacgaccctcacgctgacctgcaccatctctgggttctctctcaacgatattagaagtgggtgtgagctggactccgtcacgccccgagggacgcctggagtggcttgcacactattcttctacgaaatacgaaacgtaaaactcctaacacgtaacattctcgtagaagacgtactaacgtttaacccatacctaccgaaacggacctaaccctaacgaaaacgggtctagggttgttactttagtaactacgaaaccctaacgacgtcggaaccccgtggaccggacaccgacgcactattacgttacgngtacggacgaagggttaagngggaaacgggaaanaacgagtcgttaggtttactagttaattattaaacgttctaacgtnttacggtacgtacgggttacgggtacggggaaccgaaaccggggtacccgtacgggtaccctaccggttcctacccgtacgtaaccgtcccgttaacccgaaccggtaacccgggtaccctaccggtttacccggttcccccgtttcccccggcggggtacccccgtcccctcggtacccgaccccggtaagggccgaccccggttaccggtcggggaccgggggacctaaccgggcccggtccccggg

SEQ ID NO: 438791 - DNA, 702 bp, Homo sapiens
  misc_feature: GZ8MTXP02G40CW.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaggccctggagtggcttgcacacatcttctcgaatgaacgaaaatcctacagtacatctctagaagagactacgtttaaccatcctaccaaggaccacctaccaaaaggctaggtgtactttagtatagaaccaacatggaccctgacggacaccgagcacatatactgtgcgacgggtaatgacgggaaaagaacgagtcgtaggtttctagtattaagtaagttcttaaccagttacgtggacgttcggtacgggtaacgaaaacggggtacccgtacgggtacctaacccggttcctcccgtacgaccggttaccttaccccgaaacccgtaaccgggggtaccccctaacggttcccgggttcccccgtttaccccccggtcggggtacccccgtaccccccgttgggaccccccgttaccggaaccggggaacccgtacccgtaacccccggtttcggggtaccgggggtacccaaacccggggacggtacccccggggg

SEQ ID NO: 438792 - DNA, 620 bp, Homo sapiens
  misc_feature: GZ8MTXP02FZWXL.44.36.D03.1.454.CMB.2.raw
  modified_base (290)..(290): a, c, t, g, unknown or other
  modified_base (302)..(302): a, c, t, g, unknown or other
  modified_base (347)..(347): a, c, t, g, unknown or other
  modified_base (376)..(376): a, c, t, g, unknown or other
  modified_base (393)..(393): a, c, t, g, unknown or other
  modified_base (424)..(424): a, c, t, g, unknown or other
  modified_base (513)..(513): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatanggactgggtccnccagggcctccgaggggaaggggctgggagtggcttgggcccganaagtaaaaacaagttcgaccagtctttancaacagacgtacgccgngtctgtagaaacgccaagtattcccaccctntacgaaagacgatacgaactttcaaaagtaccttactaatttgaactttcaggactaaatcgaaacttaaacccgtaaggaaaacccgnggaaccacggggcagttgttaatttagttggttagtttagttacgtttaataagtaacgtaaggtaacttcggtacccgaacggttccgggggacctaaaccggggg

SEQ ID NO: 438793 - DNA, 587 bp, Homo sapiens
  misc_feature: GZ8MTXP02ICXEJ.44.36.D03.1.454.CMB.2.raw
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagttcagggcagagtcaccatgaccagggacacgtccagagcacagcacatggagctgagcagtcagagactcgtgaggacatagatgtgtactactgtgcgagaccgagagacaagacaaagaaaagtagtttatttagacgttacgtacggggaccgaacgggtaaacccgttcggtaccgtaccggttaccctccgtaccgtaccgacccgttacccgacccggaaacgggccccaaccgttcccgggtccccttcccccgtcggaccctaccccttccccaccgaacgaccggcccaacccgttcggaccgggggaccacggaccggcccggcccgttcgggccg

SEQ ID NO: 438794 - DNA, 599 bp, Homo sapiens
  misc_feature: GZ8MTXP02IPGRV.44.36.D03.1.454.CMB.2.raw
  modified_base (343)..(343): a, c, t, g, unknown or other
  modified_base (351)..(351): a, c, t, g, unknown or other
  modified_base (353)..(353): a, c, t, g, unknown or other
  modified_base (372)..(372): a, c, t, g, unknown or other
  modified_base (377)..(377): a, c, t, g, unknown or other
  modified_base (559)..(559): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctagaagagcagtttaaccatctacaagacacctacaaaggcaggtgtacttagtatcgacaacatcggacctgcgacacagacanatattacngngcagggtatggacggaaanaaacngctgttctagtaattataagttacttacattcgtaggtacgtcgtaggggacaaagggacccgtacgggtacctaccggtccctccgtactaggtcccttacccgaccgtaaaccggggcccctaacgtttccggtcccttcccccgtcgtccccgccccttcggccctaccgacgggaacnccgtaccccggtcggacgggggcccaacgcggccccgggg

SEQ ID NO: 438795 - DNA, 609 bp, Homo sapiens
  misc_feature: GZ8MTXP02ISY4G.44.36.D03.1.454.CMB.2.raw
  modified_base (376)..(376): a, c, t, g, unknown or other
  modified_base (497)..(497): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggatacttggtccagcctggagggtccctgagactctcctgtgtcgcctctggattcaccatcagtgaccactatatggactgggtccgccaggctccgaggggaagggctgggagtggcttggccgacaagtaaaaacaagttcgaccagtcttatcacagngtacgccgcgtctgtagaaagccagacttccaccctctacaaagacgatacgtaacttacaaacgtaacttacaatttgaatttctagacgtaaatcgaacctaaaccgtagaaaaaccgnggaaccgacgggactagtagttaatttattaggttgtttagttagttttaatagttaacgtaagggtaaaccttcggtacccgtaacggttcgggggaccgtaaaccggggg

SEQ ID NO: 438796 - DNA, 574 bp, Homo sapiens
  misc_feature: GZ8MTXP02H4IYH.44.36.D03.1.454.CMB.2.raw
  modified_base (396)..(396): a, c, t, g, unknown or other
  modified_base (445)..(445): a, c, t, g, unknown or other
  modified_base (495)..(495): a, c, t, g, unknown or other
  modified_base (517)..(517): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttcctgttgtatttacaaggtgtcagagtgaagtgcagttggtggagtccgggggagacttggtcagcctggagggtccctgagactctcctgtgtcgcctctggattcaccatcagtgaccactatatggactggggtccgcctagggcctccgaggggaaggggctgggagtgggcttggccgacaagtaaaaacaaagttcgccagtctttatcacagagtacgccgcgttctgtanaaaacgccctaagacttccaccctctacgaaagagatgaacttcgaaanaactcatttgaatttctgaccgaatcgtaactaaaccctgaaaaaaccgnggaaccagggactatgtaattnttagttgttagtgtttactatcgaaggaacttgaccacgttcggggaccaaccgggg

SEQ ID NO: 438797 - DNA, 651 bp, Homo sapiens
  misc_feature: GZ8MTXP02JZRU3.44.36.D03.1.454.CMB.2.raw
  modified_base (217)..(217): a, c, t, g, unknown or other
  modified_base (304)..(304): a, c, t, g, unknown or other
  modified_base (342)..(342): a, c, t, g, unknown or other
  modified_base (372)..(372): a, c, t, g, unknown or other
  modified_base (378)..(378): a, c, t, g, unknown or other
  modified_base (391)..(391): a, c, t, g, unknown or other
  modified_base (510)..(510): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacgttggtccagcctgggagggtccctgagactctcctgtgtcgcctctggattcaccatcagtgaccactatatggactgggtccnccaggctccgagggagggctgggagtggcttggccganaagtaaaaacaaggttcgcccagtctttancacagngtacgccgctcgngtacgaaacgcccaagtactttccaccccttctaccgaagagatagaacttagaaacgtaactccaattgattcgtaggacgtaaacttgaaaccttaaacccgaggaaaaaaccccgngggaaaccgaacgggggacctaaggtacggttaaatttaagtttggttaggttttacgttaggttttaacttaagttcgtaaacgggggtaaaccttcggttaccccgaaacggttcggggggaacccctaaacccggggg

SEQ ID NO: 438798 - DNA, 597 bp, Homo sapiens
  misc_feature: GZ8MTXP02J08RL.44.36.D03.1.454.CMB.2.raw
  modified_base (310)..(310): a, c, t, g, unknown or other
  modified_base (377)..(377): a, c, t, g, unknown or other
  modified_base (459)..(459): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtcgaccactatatggactgggtccnccgaggctccgaggggaggggctggagtggcgttggccgcaagtaaaaacaagttgaccagctttanacacgagacgtaccgccgtcgtcgtagtacgaaacgccaagtacttcccaccctcacaagagatacgtactacaaagtactntaagttgtattcgagacgtaatacgaaacctaaaccgtaacgaaaacccggaggaaaccgacgggactaagttagttaacgtttatttaggttagtttaagttagtttaactacgttacgaacggtaactcggtaccg

SEQ ID NO: 438799 - DNA, 551 bp, Homo sapiens
  misc_feature: GZ8MTXP02H6P85.44.36.D03.1.454.CMB.2.raw
  modified_base (209)..(209): a, c, t, g, unknown or other
  modified_base (223)..(223): a, c, t, g, unknown or other
  modified_base (358)..(358): a, c, t, g, unknown or other
  modified_base (368)..(368): a, c, t, g, unknown or other
  modified_base (382)..(382): a, c, t, g, unknown or other
  modified_base (389)..(389): a, c, t, g, unknown or other
  modified_base (399)..(399): a, c, t, g, unknown or other
  modified_base (408)..(408): a, c, t, g, unknown or other
  modified_base (436)..(436): a, c, t, g, unknown or other
  modified_base (529)..(529): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccggggganacttggtccagcctggagggtccctgagactctcctgtgtcgcctctggattcaccatcagtgaccactatatggactgggtccgcaggctccgagggaggggctggagtggcttggccgcagtaaaacaagttnccagctttancacagagtacgcgngtctgtnaaagccaagnttcaccctntacaagagatgaacttcaaagaaccttnattgattcgagactaatacgaacctaaaccgagaaaaccgacggacgacgggctaagtcgttaatttacgttggttagttaagttagtttaanacgtcgaaggtactcggtaccg

SEQ ID NO: 438800 - DNA, 595 bp, Homo sapiens
  misc_feature: GZ8MTXP02GM7H7.44.36.D03.1.454.CMB.2.raw
  modified_base (270)..(270): a, c, t, g, unknown or other
  modified_base (310)..(310): a, c, t, g, unknown or other
  modified_base (377)..(377): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctntggattcaccatcagtgaccactatatggactgggtcccnccaggctccgaggggaaggggctggagtggcttggccacgaagtaaaaacagttcgccagtctttancaacagacgtaccgccgtcgtctagtagaaacgccaagtactcccaccctctacaaagagatacgtacttacaaagtaacttcagttgattccgtagacgtaattacggaactaaaccgtaacggaaaaacccggagggaaaccgacggggaactagttcgttaatttagttgttagtttgttagtttaatacgttacgaacggtacgttcgtacccg

SEQ ID NO: 438801 - DNA, 583 bp, Homo sapiens
  misc_feature: GZ8MTXP02GE70G.44.36.D03.1.454.CMB.2.raw
  modified_base (189)..(189): a, c, t, g, unknown or other
  modified_base (281)..(281): a, c, t, g, unknown or other
  modified_base (285)..(285): a, c, t, g, unknown or other
  modified_base (393)..(393): a, c, t, g, unknown or other
  modified_base (449)..(449): a, c, t, g, unknown or other
  modified_base (478)..(478): a, c, t, g, unknown or other
  modified_base (507)..(507): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacaaggtntccagagtgaagtgcaggttgggtgggaggtccgggggagtacgttggtccagccgtgggacgggtccctgacgactctcctgtgtcgcctntggnttcaccatcagtcgaccactatatggacgtgggtcccgcgaggcctccggaggggaggggctgggagtggctgggccactaagtaaaaacagttcgaccagtctttancacagacgtaccgccgcgtctgtagaaacgccaagtacttccacccttcacaaganatgacttacgaaagtactcattgattcgngacaatcgaacctaacgaacgaaaaccgnggaccgagggctaagtgttaatttagtttgttagttgtttacgtttaatacgtacgtaaggtaacctcgtacccgg

SEQ ID NO: 438802 - DNA, 570 bp, Homo sapiens
  misc_feature: GZ8MTXP02J02DN.44.36.D03.1.454.CMB.2.raw
  modified_base (349)..(349): a, c, t, g, unknown or other
  modified_base (360)..(360): a, c, t, g, unknown or other
  modified_base (519)..(519): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatgaacgaaaatcctacagtacatctctagaagagctagtttaaccatctacaagacacctacaaagcaggtgtacttagatgacacatgacctgacgacacagcacatatacngtgcaggtaangaagggaaaagaaacagtcgttaggttctagttaattaataagtctaacctagtcgtggacgtcgtaggggacaaaggggcccacggtacaccgtctcctacgacgccttaccgaaccgaacgggccctacgtcccggttaccctcccccgcggtcccncccgtcgcctacccgaggaacgccaccgtcggacggggccacggcgcccgg

SEQ ID NO: 438803 - DNA, 567 bp, Homo sapiens
  misc_feature: GZ8MTXP02JO773.44.36.D03.1.454.CMB.2.raw
  modified_base (298)..(298): a, c, t, g, unknown or other
  modified_base (345)..(345): a, c, t, g, unknown or other
  modified_base (353)..(353): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattacctgtgggggcgacgccgttggaggtaaagtgtacagtggtaccagcagaagccaggccagacccctgtgctggtcatctattangatgcggccgcctcagtgatccctgcgcgctccgtccgctccactcncgggaacnccggccaccctgaccatcagcgaggggtcgacgggccgggggatggacgggccgacgtattacgtggtcaggtctggtgggacagtagtaggtgatcacgttcccgtggtacgttcgggacgggacgggaccaaggcgtacggtacccggtccgtacggggtccacggacccgaaggccctccggcccccgtgggtccaccgttccgttcccgg

SEQ ID NO: 438804 - DNA, 746 bp, Homo sapiens
  misc_feature: GZ8MTXP02I4JKF.44.36.D03.1.454.CMB.2.raw
  modified_base (324)..(324): a, c, t, g, unknown or other
tcagacagtatatacacgaccggtgctcgatttagctgcgtcacgatctctcttggggagctctgagagcggagccccagccccagaacttcccaggtgttttcatttggtgatcagcactgaacacagaggactcaccatggagttcgggctgagctgggttttccttgttgttatttacaggtgtcagagtgaagtgcagttgggtggaggtccgggggagtacgttggtccaggccgtgggacgggtccctggagacctctccgtggtcgtcgcctcgtggacttcaccatcagtgaccactatagtggacgtgggtcccncgaggctccgaggggaagggctgggagtggctgggccacgtaagtaaaaacaggttcgaccagtctttagacaacgagacgtacgccgtcgtctagtagaaacgcccaagtacttcccaccctcgtacaaaggtacgaagtacgtaaacgtttaccaaaaggtaaaccttcgtaagtttacggtaactttaccgtaggtaaccgtaaagttaacgtaaacccgtttaaaacccggtaaaccggtaaaaaaacccgggtacggggtaaaacccgaaacccgggggtaacctttaaagggttaacgttttaaaacgtttaacggtttttgggttttaacggtttttaaggtttttaacggtttttaaacttaaacgttacccggttaaaagggggttaaaccctttaccgggtaaacccccggg

SEQ ID NO: 438805 - DNA, 592 bp, Homo sapiens
  misc_feature: GZ8MTXP02GW75E.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagtacgttggtccaggccgtgggagggtccctgagactctcctgtgtcgcctctggattcaccatcagtcgaccactatatggacgtgggtcccgccgaggcctccgaggggaacggggctgggagtggcttgggccgacaagtaaaaacaagttcgaccagtctttatcaacagacgtaccgcgcgtctgtagaaacgcccagacttcccaccctctacaaagagatcgtaacttacaaagacttcatttgattcagacgtaatcgaaacctaaaccgtagaaaacccggaggaaccgaacggggctaagttacgttaagttagttgtttagttgttagtttatactcgtaaggtacttacgtacccg

SEQ ID NO: 438806 - DNA, 586 bp, Homo sapiens
  misc_feature: GZ8MTXP02JEL96.44.36.D03.1.454.CMB.2.raw
  modified_base (305)..(305): a, c, t, g, unknown or other
  modified_base (317)..(317): a, c, t, g, unknown or other
  modified_base (387)..(387): a, c, t, g, unknown or other
  modified_base (483)..(483): a, c, t, g, unknown or other
  modified_base (520)..(520): a, c, t, g, unknown or other
  modified_base (528)..(528): a, c, t, g, unknown or other
  modified_base (567)..(567): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttgggtcccaggcctgggagggtcccctggagactctcctgtgtcgcctctggattcaccatcagtcgaccactatanggactgggtccnccaggcctccgaggggacggggctgggagtggcttcggcgacaagtaaaaacaagttcgccagtctttancacagagtacgccgcgtctgtagaaacgccaagacttcccgacccttacacaaagagtatcgaacctttcaaaagacccttgattcgtaatttccnggacctaaatcggaacttaaacccgaggaaaacccgnggaaccgngggactagtgtaatttagttggtagtttgtagttttaanactacgacgtactcgtccg

SEQ ID NO: 438807 - DNA, 642 bp, Homo sapiens
  misc_feature: GZ8MTXP02HVGUO.44.36.D03.1.454.CMB.2.raw
  modified_base (310)..(310): a, c, t, g, unknown or other
  modified_base (378)..(378): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtcgaccactatatggactgggtccncaggctccgaggggagggctggagtggcttgggccagaaagtaaaaacaagttcgacctagtctttancaacaggacgttaccggcccggtcgttccgtagtaggaaaacgcccaaggtaactttcccaaaccccttctaacgaaaggtaagacttacgaactttacggaaaactaaccttactaatttaggaactttcgagggacctaaaagtcggaaaccttaaaccgaacggaaaaaccccggaggaaccgtaaacggggctaaagttaggtaatttacgtgtttagttgtttagtttaactatacgtaacggtactttcgtaacccgg

SEQ ID NO: 438808 - DNA, 563 bp, Homo sapiens
  misc_feature: GZ8MTXP02GZ9WF.44.36.D03.1.454.CMB.2.raw
  modified_base (308)..(308): a, c, t, g, unknown or other
  modified_base (374)..(374): a, c, t, g, unknown or other
  modified_base (393)..(393): a, c, t, g, unknown or other
  modified_base (415)..(415): a, c, t, g, unknown or other
  modified_base (438)..(438): a, c, t, g, unknown or other
  modified_base (484)..(484): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatcagtgaccatatatggactgggtccnccaggctccgagggaggggctggagtggcttggccgcaagtaaaaacaaagttcgccagtctttancacagagtaccgcgcgtcngtgaaagccagattccaccctncaagagatgacttcaaagacctnaattgaattctagcgaaatcgaacttaaacccgaggaaaaacccgnggaaccacggggtacattacggttaatttagtttgtaggtttgttgttttaactattcgaaaggtaacctggttacccg

SEQ ID NO: 438809 - DNA, 535 bp, Homo sapiens
  misc_feature: GZ8MTXP02HL9D9.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtggggggaggcgttgggtacgaggcggggggggtccctggagactctcctgtgcagcctctggattcatcttcagtgactatgccatgaactggggtccgccaggcctccgagggaggggctggaggtgggttccatatagttaatattgctggagtactaccacctactacgcagactctgtgaagggcctatcgaaccattccgagggacaatcgaccaaagaactcactgtatcgtaggaaatgaacagcctaggagacggacgaggacgacggctacgtcttacgtctgttcgagtacggacgtcggactacgttgg

SEQ ID NO: 438810 - DNA, 692 bp, Homo sapiens
  misc_feature: GZ8MTXP02G4H97.44.36.D03.1.454.CMB.2.raw
  modified_base (324)..(324): a, c, t, g, unknown or other
  modified_base (410)..(410): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgtgcttgggttttccttgttgttattttacaaggtgtccagagtgaagtgcaggttggtggaggtccgggggagtacgttgggccaggccgtgggacgggtccctggacgactctccgtgtgtccgcctctggacttcaccatcagtcgacctatatagtggactgggtccncaggcctaccgaaggggaaggggtctagggagtcgggcgttcgggccgacgaaagtaaaaaacaaggttcgacctaagtctttacnctaacaagggacgtaccgaccgcgttcgtacgtagaaaaccggtccaaggtacctttacccaccccttctaacgaaaagacgtaagttacgtaaccttaacgaaaaggtaacccttagtaagtttagtaactttcgacgtaacgtaaacgtaccgtaaaacctaaaccgtaaacggaaaaacccggtacggaaaccgacgggtaactagtttacggtttaatttacgttggtttagtttaacgtttagtttaacgtactacggtaacggttacgtcgtaccg

SEQ ID NO: 438811 - DNA, 603 bp, Homo sapiens
  misc_feature: GZ8MTXP02IWKXW.44.36.D03.1.454.CMB.2.raw
  modified_base (331)..(331): a, c, t, g, unknown or other
  modified_base (399)..(399): a, c, t, g, unknown or other
  modified_base (543)..(543): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaacggccctggagtggcttgcacacatcttctcgaatgaacgaaaatcctacagtacatctctgaagagctagtttaaccatcctaccaaggaccacctaccaaaaggcaggtgtactttagtatcgacccaanagtcggaccctgacggacacgagcacatattactgtgacgtaacgggtaatggacgggaaaagaaacngtacgttggtttctagttaattagtaacgttacttaccattcgtaggtacgtcggtaggggacaaaggggccctagggtccaccggttcctcctcgacgtccttaccaccgaacgggcccctagttccggtccctttcccccgnggcccgtcccgtcgtcctccgaggaaccgccgtaccgtcgggcgggaccacggcggccgg

SEQ ID NO: 438812 - DNA, 742 bp, Homo sapiens
  misc_feature: GZ8MTXP02HF5MJ.44.36.D03.1.454.CMB.2.raw
  modified_base (313)..(313): a, c, t, g, unknown or other
  modified_base (436)..(436): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagctctcctgtgtcgcctctggattcaccatcagtgaccactatagtggactcggggtcccncccgagggccttcccggaagggggaacgggggccttaggggacggtggggtccgtttcggggccccgtaccgaaaacggttaaaaaaacaaagggtttcgaccccgtaaggttccctttttanaccgaacgaacggacgtaccggcccgtcgttcgtagtaacgaaacgccaagtacttcccacccttcacgaaagagtatacgtaaccttacgaaacgtacttactaagtttggtactttacgtacggaacgtaaacgttacgtaaaacccgttaaaccgtaaaacggaaaaaccccgggtaacgggaacccggtaacggggtacctaaaggtttaacgtttaaacgttttacggtttaggtttaggttttaacggtttagttttaaactacggtaccggtaaacggttaacgttaccggtaacccgg

SEQ ID NO: 438813 - DNA, 555 bp, Homo sapiens
  misc_feature: GZ8MTXP02IOQA5.44.36.D03.1.454.CMB.2.raw
  modified_base (380)..(380): a, c, t, g, unknown or other
  modified_base (427)..(427): a, c, t, g, unknown or other
  modified_base (439)..(439): a, c, t, g, unknown or other
  modified_base (458)..(458): a, c, t, g, unknown or other
  modified_base (472)..(472): a, c, t, g, unknown or other
  modified_base (501)..(501): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacgttggtccagccgtggagggtccctgagactctcctgtgtcgcctctggattcaccatcagtgaccactatatggactgggtccgcaggctccgaggggaagggctggagtggcgttggccgacaaagtaaaaaaccagttcgaccagtctttancaacagagtaccgcgcgtctgtagaaaagccaagactttccaccctntacaaagagtancgaaacttcaaagaacctnaatttgatttccgngacgaatcgaaacctaacgagaaaaccgngaacgacggactatgtaattattgtgtgttacttataacacgtaacgactcgac

SEQ ID NO: 438814 - DNA, 559 bp, Homo sapiens
  misc_feature: GZ8MTXP02IDQDI.44.36.D03.1.454.CMB.2.raw
  modified_base (217)..(217): a, c, t, g, unknown or other
  modified_base (374)..(374): a, c, t, g, unknown or other
  modified_base (485)..(485): a, c, t, g, unknown or other
  modified_base (496)..(496): a, c, t, g, unknown or other
  modified_base (520)..(520): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggaggtccctgagactctcctgtgtcgcctctggattcaccatcagtgaccactatatggactgggtccgccaggctccgaggggaaggggctgggagtgggcttgggccgacaagtaaaaaacaagttcgacccagctttancaacagagtaccgccgacgttctggtagaaagcccaagattccaccctctacaaagacgatgacttcaaagactcattcgatttctgacgaatcgaactaactgaaaacgnggaacacgggnatgtatttatgtagttgtgtttanataacgaggaacttggaccacgtcggggaccaaccgggg

SEQ ID NO: 438815 - DNA, 675 bp, Homo sapiens
  misc_feature: GZ8MTXP02HETUB.44.36.D03.1.454.CMB.2.raw
  modified_base (317)..(317): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagtacgttgggtccaggcctgggacgggtccctgagactctcctgtgtcgcctctggattcaccatcagtgaccatatatggacgtgggtccncgaggctcgagggagggctggagtggctggccgacaaaggtaaaaaccaaagttcgaccagtctttatcaacagacgtaccggccctacgtcgtcgtagaaaacgccaaggtacttcccaaccctctacaaagagatcgaaccttacaaacgtaaccttactagtttagtaactttccgaggtaccggtaaattacggtaaacccttaaaacccgtaacgggaaaaaaacccggtacggggaaacccgaaccgggggacctaaaggtttacggtttaaactttaacgtttggttaggttttaagtttaacggttttaactaggtaccgtaaaggggtaaacctttcgttaaccccggg

SEQ ID NO: 438816 - DNA, 580 bp, Homo sapiens
  misc_feature: GZ8MTXP02JVZXA.44.36.D03.1.454.CMB.2.raw
  modified_base (356)..(356): a, c, t, g, unknown or other
  modified_base (524)..(524): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaaggccctggagtggcttgcacacatcttctcgaatgaacgaaaatcctacagtacatctctgaagagcagtttaaccatctaccaagaccacctaccaaaggcaggtgtctttagtatgaccaacatcggaccctgcgacaccagcacatattacngtgcgaacgggtatggacgggaaaagaaacgagtcttggtttctagttaattataagttcttaccatcgtggacgttcgtaggggacgaaacgggaccacgggtcacccggttctccctacgacgtccttacccaaccgacgggcccagttcccggtcccttccccgnggcccgccctcgcctccgaggccgcctaccgtcggtacggggccaacggcgcccgg

SEQ ID NO: 438817 - DNA, 580 bp, Homo sapiens
  misc_feature: GZ8MTXP02IRD5P.44.36.D03.1.454.CMB.2.raw
  modified_base (207)..(207): a, c, t, g, unknown or other
  modified_base (305)..(305): a, c, t, g, unknown or other
  modified_base (366)..(366): a, c, t, g, unknown or other
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttatttacaaggtgtccagagtgaagtgcagttggnggagtccgggggagacttggtccagcctggagggtccctgagactctcctgtgtcgcctctggattcaccatcagtcgaccatatatggactgggccncaggctccgaggggagggctggagtgctggccacaaagtaaaacaagttgccagtctttancaacgagacgtaccgccgtacgtctagtagaaacgccaagtacttcccacccttntacaaagagatcgaacttacaaaagtactctaattgaattccgagacgtaaatcgtaaacctaacgtaagaaaaacccggcgaacgacggtactaagttagttaacttagttgttagtttaagttacgtttaatacgtacgaacggttaactcgtaccg

SEQ ID NO: 438818 - DNA, 590 bp, Homo sapiens
  misc_feature: GZ8MTXP02IIZZD.44.36.D03.1.454.CMB.2.raw
  modified_base (375)..(375): a, c, t, g, unknown or other
  modified_base (399)..(399): a, c, t, g, unknown or other
  modified_base (425)..(425): a, c, t, g, unknown or other
  modified_base (519)..(519): a, c, t, g, unknown or other
  modified_base (569)..(569): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggagtccgggggagacgttggtccagcctggagggtccctgagactctcctgtgtcgcctctggattcaccatcagtgaccatatatggactgggtccgccaggctccgaggggaagggctgggagtggcttggccgcaaagtaaaaacaagttcgcagtctttncacagacgtaccgcgcgtctgtanaaacgtccaagtacttcccacccttntacgaaagacgtatgaaacctttacgaaaagtaacctcgaattttcggaatttccgagacgaaattcgaaaccttaaacccgagaaaaacccgnggaaccgacgggctaagttgtaatttagttgtacgtttgttagtttaatntaccgaagtacttcgaacccg

SEQ ID NO: 438819 - DNA, 625 bp, Homo sapiens
  misc_feature: GZ8MTXP02IQXLF.44.36.D03.1.454.CMB.2.raw
  modified_base (273)..(273): a, c, t, g, unknown or other
  modified_base (314)..(314): a, c, t, g, unknown or other
  modified_base (356)..(356): a, c, t, g, unknown or other
  modified_base (385)..(385): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttggtggaggtccgggggagacttgggtccagcctgggagggtccctgagactctcctgtgtcgcctntggattcaccatcagtgacccactatatggactgggtcccnccaggcctccgaaggggagggctgggagtggcttgggccganaaagtaaaaacagttcgaccagtctttancaacaggacgtaccgccgtacgtctagtagaaacggcccaaggtacttcccaccctctacaaagagtatacgtaacttacaaaagtaaccttacgaattgtattccgtagaccgtaaatcggtaaacctaaacccgtaacgaaaaacccggaggaacccgtacggggactaagttacgttaatttagtttggtagtttgttagtttaactagtacgtaacggtaacgttacgtaacccgg

SEQ ID NO: 438820 - DNA, 586 bp, Homo sapiens
  misc_feature: GZ8MTXP02JBPTO.44.36.D03.1.454.CMB.2.raw
  modified_base (224)..(224): a, c, t, g, unknown or other
  modified_base (350)..(350): a, c, t, g, unknown or other
  modified_base (376)..(376): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctggacgggtccctgagctctcctgtgtcgcctctggattcaccatcagtcgaccactatatggactcgggtccgcgaggctccgaggggaacggggctggagtggcttggccncaagtaaaaacagttgccagctttancacagacgtacgccgctctgtagaaagccagacttccgaaccctctacaaagacgatacgtacttacaaagtaactcgaatttgaatttcctagacgtaaatcgaaacctaaaccgtagaaaaacccggaggaaccgtaacggggactaggttacgttaacttacgttggttagtttgtagttttatagtacgtaaggaacgtgtacccg

SEQ ID NO: 438821 - DNA, 631 bp, Homo sapiens
  misc_feature: GZ8MTXP02HJNWX.44.36.D03.1.454.CMB.2.raw
  modified_base (284)..(284): a, c, t, g, unknown or other
  modified_base (290)..(290): a, c, t, g, unknown or other
  modified_base (311)..(311): a, c, t, g, unknown or other
  modified_base (404)..(404): a, c, t, g, unknown or other
  modified_base (434)..(434): a, c, t, g, unknown or other
  modified_base (473)..(473): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccagccgtgggagggtccctgagctctcctgtgtcgcctctggattcaccntcagtnaccatatatggactgggtccncaggctccgaggggagggctggagtggctggccgacaaagtaaaaacaagttcgacctagtactttatacaacagtacgtaccgccgcgttcngtagaaacgccaagtacttcccaacccttntaacgaaagcgatcgtaaccttacaaaagtaaccctttntaagtttgacttcgagtacgtaaatacgaaacctaaaccggtaacggaaaaacccggtaggaaccgtacgggacttaaggtttacgtttaactttagtttggttaggtttaagtttacgtttaatacgttacgtaacggttaccgtttacggtacccg

SEQ ID NO: 438822 - DNA, 617 bp, Homo sapiens
  misc_feature: GZ8MTXP02F7JB8.44.36.D03.1.454.CMB.2.raw
  modified_base (276)..(276): a, c, t, g, unknown or other
  modified_base (283)..(283): a, c, t, g, unknown or other
  modified_base (312)..(312): a, c, t, g, unknown or other
  modified_base (349)..(349): a, c, t, g, unknown or other
  modified_base (376)..(376): a, c, t, g, unknown or other
  modified_base (391)..(391): a, c, t, g, unknown or other
  modified_base (425)..(425): a, c, t, g, unknown or other
  modified_base (464)..(464): a, c, t, g, unknown or other
  modified_base (525)..(525): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtccagagtgaagtgcagttggtggaggtccgggggagacgttggtccagccgtgggacgggtccctgagctctcctgtgtcgcctngatcacntcagtcaccatatagtggactgggtcccncaggcctccgaggggagggctggagtggcttggccanaaagtaaaaacagttgaccagtctttncaacagacgacgccngtctagagaaacgccaagtcttacccaccccctntaacgaaagatactacgtaaaccttacaaaagtaccttntatttacgattccgagaccgtaaataccgtaaacctaaaccgtaaaacggaaaaacccggnggaacccgaacgggtactaagttacgtttaatttagttggttaggttaacgtttagtttaaactactacggtaacggtaactttcggtaccg

SEQ ID NO: 438823 - DNA, 627 bp, Homo sapiens
  misc_feature: GZ8MTXP02I6T5C.44.36.D03.1.454.CMB.2.raw
  modified_base (314)..(314): a, c, t, g, unknown or other
  modified_base (384)..(384): a, c, t, g, unknown or other
  modified_base (436)..(436): a, c, t, g, unknown or other
  modified_base (542)..(542): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacttgggtccagccgtgggagggtccctgagactctcctgtgtcgcctctggattcaccatcagtgaccactatatggactggggtcccnccaggcctcgaggggaagggctgggagtggcttggccgacaaagtaaaaacaagttcgacctagtctttncaagagacgtaccgccgcgtctgtagaaacgccaagtactttccaacccttntacaaaggagtactggtaaacctttacgaaaacgtaccttcaatttagaactttccagaccgtaaaattcggaaacccttaaaccgtaacggaaaaaaccccgggnggaaccgacgggacttaagttacgttaagtttagttggttagtttaagttagtttaactacgtacgtaacggtacttcggtaccg

SEQ ID NO: 438824 - DNA, 624 bp, Homo sapiens
  misc_feature: GZ8MTXP02HAGDJ.44.36.D03.1.454.CMB.2.raw
  modified_base (217)..(217): a, c, t, g, unknown or other
  modified_base (263)..(263): a, c, t, g, unknown or other
  modified_base (293)..(293): a, c, t, g, unknown or other
  modified_base (349)..(349): a, c, t, g, unknown or other
  modified_base (379)..(379): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggaggtccctgagactctcctgtgtcgcctntggattcaccatcagtcgacctactatagnggactcgggtcccgccagggctccgaggggaagggctgggagtggcgttggccganaaagtaaaaacaagttcgacctagctttancacagagtacgccgcgtcgtgtagaaaacgccaagacttccaaccctctacaaacgagactcgtaacttacgaaaacgtaacctctaaatttcgaacttttccgaggaccgtaaatcggtaaacctaaaccgtaaggaaaaaccgtaggaacgacgggactaagttagtaattttagtagttaggtttgttagtttaactagtaacgaaggtaactcgtaccacggtacggggacctaaccgggg

SEQ ID NO: 438825 - DNA, 557 bp, Homo sapiens
  misc_feature: GZ8MTXP02JQPQI.44.36.D03.1.454.CMB.2.raw
  modified_base (222)..(222): a, c, t, g, unknown or other
  modified_base (295)..(295): a, c, t, g, unknown or other
  modified_base (307)..(307): a, c, t, g, unknown or other
  modified_base (340)..(340): a, c, t, g, unknown or other
  modified_base (369)..(369): a, c, t, g, unknown or other
  modified_base (372)..(372): a, c, t, g, unknown or other
  modified_base (395)..(395): a, c, t, g, unknown or other
  modified_base (487)..(487): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacgttggtccagcctggagggtccctgagactctcctgtgtcgcctctggattcaccatcagtgaccatatanggactgggtccncaggctccgagggagggctggagtggctggccncgaagtaaaaacaagttgccagtctttancanagagtacgcgcgtctgtagaaanccagattccaaccctcgtacaagagtatagaacttcgaaagtacctcatttggaatttcgagacgaatcgaacctaaaccgtagaaaaccgnggaacaccgggatagtagttattagttgttgttgttcgtttaatctacgtaggtaaacttcggtaacccg

SEQ ID NO: 438826 - DNA, 723 bp, Homo sapiens
  misc_feature: GZ8MTXP02I0CN0.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggtttcctgttgttatttacaaggtgtccagagtgaagtgcagttggtggaggtccgggggagacgttggtccagcctgggagggtccctgagactctcctgtgtcgcctctggattcaccatcagtcgaccactatatggacgtgggtcccgccgaggccgtacccggagggggtaaacggggcgtaggggacggtgggtccgttcggggcccgaccgaaaacggttaaaaaaccgtaaaaggtttcgacccctaaggtaccttttacgtccaaacaaggtacgttaacccgcccggtcgttctaggtacggaaaacgcccaagtactttacccaacccccttctaccgaaaaggagtaactcggtaaacctttaccgaaaagtaaaccttctaatttaggtaaactttccgaggtaaccgtaattaacggtaacctaaaaccgtaacgggaaaaacccggaggggaaaccgacgggggactaagttaggtttaactttaagtttggtttagtttggttacgtttaattagttaaccgaagggttaaccttcgggttaccccg

SEQ ID NO: 438827 - DNA, 739 bp, Homo sapiens
  misc_feature: GZ8MTXP02G5J80.44.36.D03.1.454.CMB.2.raw
  modified_base (368)..(368): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctacagtacatctctagaagagcagtttaaccatcctaccaaggaccacctaccaaaaggcaggtggtactttagtatcgaccaacagtcggacctgacggacaccgagcacatattacgngtgacgtaacggggtaatacgggaacggggaaaagaaaccgagtacgttaggtttacctagttaattaagtaacgttacttaacccgattacgtagggacgttcgggtagggggaaccgaaaacgggggacccgtaaccgggtccctaacccggttcccttacccgtaccgtaacggtccctttacccccgaaacccggtaaaccgggccccctaaccggttccccggggttacccccttttccccccggtccggggcccccttacccccggttccggccccgttacccccggaaagggcccggttaccccgaaccccggtttaccggggtcccggggggacccctaaccggggacccggtcccccggggg

SEQ ID NO: 438828 - DNA, 692 bp, Homo sapiens
  misc_feature: GZ8MTXP02HK6F7.44.36.D03.1.454.CMB.2.raw
  modified_base (320)..(320): a, c, t, g, unknown or other
  modified_base (404)..(404): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacgttggtccagccgtgggacgggtccctggagactctcctgtgtcgcctcgtgacttcaccatcagtcgaccactatagtggactcggggtcccnccgaggcctccggaaggggacggggtctgggagtgggcttcggggccgacgtaaagtaaaaacaaggttcgaccagttctttancaacaggacgtaccgccgcgtctgtacgaaacgcccaaggtacttacccgaacccttctaacgaaacgtaagtattacgtaaacctttaacgaaaacgtaacttacctaagtttagaactttaccgaggtaacgtaaacgttacggtaaacccttaaaccggtaaacggaaaaacccggtacgggaaaacccgtacggggactaggttaacgttaagtttaacgtttggttaggttttaacgttagttttaactacgtacgtaacggttaaccgttacggtaccccgg

SEQ ID NO: 438829 - DNA, 621 bp, Homo sapiens
  misc_feature: GZ8MTXP02FJN5C.44.36.D03.1.454.CMB.2.raw
  modified_base (306)..(306): a, c, t, g, unknown or other
  modified_base (376)..(376): a, c, t, g, unknown or other
  modified_base (461)..(461): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccactatatggactgggccncaggctccgaggggaaggggctgggagtggcttgggccgacaagtaaaaacaaagttcgaccagctttancacagacgtacgccgtcgtctgtagaaacgccaagacttacccacccctctacaaagagtatcgtaacttacaaaagtaaccttntaatttaggtactttcgtggacgtaaatacgaaaccttaaacccgtaaacggaaaaacccggtacggaacgaccggggtactaagttagtttaaactttacgttgttacggtttaagtttagtttttaacacgttacgtaacgggtaacttcggtacccg

SEQ ID NO: 438830 - DNA, 606 bp, Homo sapiens
  misc_feature: GZ8MTXP02GBR4R.44.36.D03.1.454.CMB.2.raw
  modified_base (378)..(378): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccgccaggctccgaggggaaggggctgggagtggctggccgacaagtaaaaacaagttcgaccagtctttancaacagacgtaccgccgcgtctgtagaaaagcccaagacttcccaacccctctacaaagacgatgaacttacaaaggtaacctnatttgaatttcccgaggaccgtaaatcggaaacttaaacccgtaggaaaaacccgaggaaccgaacggggtcaaagttgtaactttagttcgttagtttaaggttacgttttaatactcggaaacggtaacttcggtaaccccg

SEQ ID NO: 438831 - DNA, 683 bp, Homo sapiens
  misc_feature: GZ8MTXP02GMMHK.44.36.D03.1.454.CMB.2.raw
  modified_base (467)..(467): a, c, t, g, unknown or other
  modified_base (477)..(477): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcacatcagtgaccactatagtggactgggtcccgccgtaggcctccgaggggaacggggctggggagtcggcgttcgggccgacaaaggtaaaaaaccaaggtttcgaccctaagtccttttagtccaacgtaaggacgttaccgcccgtcgttctaggtagaaaacgcccaagtactttcccaaccccgtntacgaaacgngaactgaaccttacaaaggtaactcaaagtttgaactttctaggacctaaagttacgaacccttaaaacccgtaggaaaaaaacccccggtaggaaaccccggaacggggacctaaagttcggtttaaactttagtttggttagtttaaggtttacgtttttaaaatacgttaccgtaaagggtaaacctttcggttaaaccccgg

SEQ ID NO: 438832 - DNA, 614 bp, Homo sapiens
  misc_feature: GZ8MTXP02IRFL8.44.36.D03.1.454.CMB.2.raw
  modified_base (278)..(278): a, c, t, g, unknown or other
  modified_base (287)..(287): a, c, t, g, unknown or other
  modified_base (317)..(317): a, c, t, g, unknown or other
  modified_base (390)..(390): a, c, t, g, unknown or other
  modified_base (444)..(444): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggatacgttgggtccagccgtgggacgggtccctggagctctcctgtgtcgcctcnggattcacntcagtcgaccactatatggactgggtcccnccaggctaccgaggggaggggctgggagtggcttgggccgacaaagtaaaaacaagttcgaccagtcttttancaacgaggtacgtccgcgcgttactgtacgaaacgccaagtcttacccaccctntacaaganatcgtaacttacaaatacttatattgaacttcgagaactaagtacgtaaaccttaaaccgaaacgaaaacccgggagaaccgacggtactaagttacgttactttacgtttgtttaggttaagtttagtttaatacgttacgtaaacggtacttcggtaccg

SEQ ID NO: 438833 - DNA, 682 bp, Homo sapiens
  misc_feature: GZ8MTXP02FY580.44.36.D03.1.454.CMB.2.raw
  modified_base (225)..(225): a, c, t, g, unknown or other
  modified_base (382)..(382): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggaggtccggggganacgttggtccagccgtgggacgggtccctgagactctcctgtgtcgcctctggattcaccatcagtgaccactatatggacgtggtccgcaggctccgaggggaggggctggagtggctggccgtacaagtaaaaacaagttcgacctagtctttancacgagacgtacgccgtcgtctgtacgaaaacgccaaagtacctttacccaaccccgttctaaccgaaaaggtacgtaacttagtaaaccctttaacaaaacggttaaccttcgtaattttaggtaacttttcccgagggtaaccctaaaagttacggtaaaaccttaaaaccccgaaggtaaaaaaccccgggagggaaaccggaaccgggggtactaaaggttacgtttaacttttaagtttcggttaagttttgtttagtttaataccttacgaaaggttaacctcggttaaccccg

SEQ ID NO: 438834 - DNA, 575 bp, Homo sapiens
  misc_feature: GZ8MTXP02I288N.44.36.D03.1.454.CMB.2.raw
  modified_base (310)..(310): a, c, t, g, unknown or other
  modified_base (360)..(360): a, c, t, g, unknown or other
  modified_base (463)..(463): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcgttgggtacgagggcgggggggtccctggagactctcctgtgcagcctctggattcatcttcagtgactatgccatgaactggtccnccaggcctccgagggaggctggagtggttcatatgttaatattgctgganactaccacctactacgcagactcgtgtaggaacgggtccattaccaacctattccgaagggacaatgaccaaagactcacttgtaatctaggtaaatgaaacngaccgtaggaacgaacggacggaacggacaaacgggtcttacggttaccttaaccgtttcgtaacggtttacgaaggtacggtacgtccggggtaccttaacggttttcggg

SEQ ID NO: 438835 - DNA, 676 bp, Homo sapiens
  misc_feature: GZ8MTXP02J3L4B.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgctgggtttctgttgctatttagaggtgtcactgtgaggtgcggctggtggagtcgtgggggagcttggtacgaggcgggggggtcctgagactctcctgtgcagcctactggattcatcttcagtgactatcgaccatcggaacgtggggtcccgccgtaggcctaccgaaggggaacggggtcgtaggggaggttggggtttacccagttatagtttaaattgttggcgtggggaatactaccgaacctactacgcacggacttcgtgtaggaaacggggtcctattaccgaacctaagttcccgaaggggtaacctaagtccggaaccaaagggaaacctctaacgtacggttaactacgtaccgggttaaaaatcggaaaaccgacgtaccgaagggaacggaaacggaacggggaaccggaacccggtaccggtaccgttacgtacccgtttacccgttacggttaacggttaaccggaacgggtacgtacgggttaccccgggtaccttacggttcggg

SEQ ID NO: 438836 - DNA, 644 bp, Homo sapiens
  misc_feature: GZ8MTXP02FPN0S.44.36.D03.1.454.CMB.2.raw
  modified_base (271)..(271): a, c, t, g, unknown or other
  modified_base (276)..(276): a, c, t, g, unknown or other
  modified_base (304)..(304): a, c, t, g, unknown or other
  modified_base (367)..(367): a, c, t, g, unknown or other
  modified_base (459)..(459): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgctctggntcacntcagtcgacactatatgacgtgggtccncaggctccgaggggagggctggagtgcttggccacaagtaaaaacaagttcgccagtctttancacagacgtaccgccgcgtctagtagaaacgtcccgaagtactttcccacccctctacgaaagagatgtaaaccttacgaaaggaacccttntaaatttggtaacttttccgaggaccgtaaagttacggaaacccttaaaaccgtacggaaaaaacccggacgggaaaccaccgggggtacctaaagttcggtttaaatttaacgttggttttaggttaagttttaccggttttaaactagttaccggtaaaggtaaaccgttcgtttaaccccgg

SEQ ID NO: 438837 - DNA, 582 bp, Homo sapiens
  misc_feature: GZ8MTXP02FMFTI.44.36.D03.1.454.CMB.2.raw
  modified_base (273)..(273): a, c, t, g, unknown or other
  modified_base (308)..(308): a, c, t, g, unknown or other
  modified_base (362)..(362): a, c, t, g, unknown or other
  modified_base (373)..(373): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggnttcaccatcagtgaccactatatggactgggtccncaggctccgaggggaggggctgggagtggcttggccacaagtaaaaacaagttnccagtctttancacagacgtaccgcgcgtctagtagaaacgcagtacttcccaccctctacgaagtagatacgtaaccttacgaaacgtactatattacgtattcgtagacgtaatacgaaacctaaccgaacggaaaaccggacggaaccgacggactagttagttatttagttgttagttgtttacgtttaatacgtacgtaacggtactcggtaccg

SEQ ID NO: 438838 - DNA, 580 bp, Homo sapiens
  misc_feature: GZ8MTXP02FHOAV.44.36.D03.1.454.CMB.2.raw
  modified_base (352)..(352): a, c, t, g, unknown or other
  modified_base (372)..(372): a, c, t, g, unknown or other
  modified_base (377)..(377): a, c, t, g, unknown or other
  modified_base (391)..(391): a, c, t, g, unknown or other
  modified_base (395)..(395): a, c, t, g, unknown or other
  modified_base (420)..(420): a, c, t, g, unknown or other
  modified_base (428)..(428): a, c, t, g, unknown or other
  modified_base (442)..(442): a, c, t, g, unknown or other
  modified_base (463)..(463): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggaggtccctgagactctcctgtgtcgcctctggattcaccatcagtgaccactatatggactgggtcccgaccaggctaccggaggggaaggggctggggagtgggcttgggcccganaagtaaaaacagtcgccagntttancacagcgacgccgngtcngtagaaagccagacttcccaccctntacaaganatgtaacttcaaanactcattgtattctgacgaancgtaactaaacctagaaaacccgaggaacgacgggacagttgttaatttagttggttgtttagttcgttaattagtcgaaggtaactcgtaccgacggtcggggaccgtaaccgggg

SEQ ID NO: 438839 - DNA, 472 bp, Homo sapiens
  misc_feature: GZ8MTXP02GN4Z4.44.36.D03.1.454.CMB.2.raw
  modified_base (259)..(259): a, c, t, g, unknown or other
  modified_base (354)..(354): a, c, t, g, unknown or other
  modified_base (468)..(472): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttnaatctatggggccgtggcaccctggtcactgtctcctcagcttccaccaaggcccatccggtcttcccccgtggccgcccctgcctccgaggacnccacctcgtcgggggccacgacggccggccccgtggggctcggcccgtgggtaccaaacgggacttacttcctaatatactgtactgacgcggggctgggcaaggcgacatagnnnnn

SEQ ID NO: 438840 - DNA, 612 bp, Homo sapiens
  misc_feature: GZ8MTXP02HR0IJ.44.36.D03.1.454.CMB.2.raw
  modified_base (382)..(382): a, c, t, g, unknown or other
  modified_base (389)..(389): a, c, t, g, unknown or other
  modified_base (434)..(434): a, c, t, g, unknown or other
  modified_base (520)..(520): a, c, t, g, unknown or other
tcagacagtatatacacgaccggtgctcgatttagctgcgtcacgatctctcttgggggagagtggagccccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagacttggtccaggcctgggagggtccctgagactctcctgtgtcgcctctggatcaccatcagtcgaccatatatggactgggtccgccaggcctccgaggggaaggggctgggagtgggcgttggccgacaaagtaaaaacaagttcgaccaagtctttaancaacagngtaccgccgcgtcgtgtagaaaacgccaagtacttcccaaccctntacaaagacgatcgaaccttagaaataacctataatttgatttcgtagacgtaaaatgaaacccttaaacgacggaaaaaacccgnggaacgacggggactaagtcgttaattattgttgtttgttatttaactataacgaaggtaacttggtacccaaggtcggggacctaacgggg

SEQ ID NO: 438841 - DNA, 673 bp, Homo sapiens
  misc_feature: GZ8MTXP02I7KYJ.44.36.D03.1.454.CMB.2.raw
  modified_base (315)..(315): a, c, t, g, unknown or other
  modified_base (408)..(408): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcaggttggtggagtccgggggagacttggtccagccgtggacgggtccctgagactctcctgtgtcgcctctgattcaccatcagtcgaccactatagtggacgtggggtcccnccgaggccgtccgaggggaacggggctagggacggtgggtccttggggcccgacgtaaagtaaaaaaccgtaaggttcgacctaagtctttanccaacgagtacgtaccgccgtcgttcgtagtacgaaaacgcccgaaagtacttcccaaccccgttctacgaaagtacgagtcgtaaacctttacgaaacggtaaaccttctaatttgtaactttaccgtaggacgtaaagtacggtaaccttaaaacccgtaacgggaaaaacccgtaggaacccgaacgggggtactaagttagttatttaacgttggtttgtttaagttagtttatactcgtaacggtaacctttggtacccg

SEQ ID NO: 438842 - DNA, 802 bp, Homo sapiens
  misc_feature: GZ8MTXP02GDHDC.44.36.D03.1.454.CMB.2.raw
  modified_base (280)..(280): a, c, t, g, unknown or other
  modified_base (283)..(283): a, c, t, g, unknown or other
  modified_base (289)..(289): a, c, t, g, unknown or other
  modified_base (321)..(321): a, c, t, g, unknown or other
  modified_base (345)..(345): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaggtgtccagagtgaagtgcagtgtggaggtcgggtcggagtcggtcgacgcgtcggtagggtaccgtcgagacgtctcctcgtgtcgtcctctggtntcnccactncgtagaccacctatatggcgtcggtccggccncggcgtccgacggggaggggtcgnggtaggtggtcgtcggtaccggacccgtaaacgtaaaaacgtaaaacgtacggtcctaacgttacgtttacttacgaaccgaaggtaacggtaccggacccggtccggtcgttacggtaggaaaacggtacccgaacgtaacgtttacccctacccctaaccgttaacgaaacggtaaagacgttacgtaaaccttaaaccgtaaacgaaacttacctagttagggttaccctttacgttacggaacgtaaaacgttacgtaaaacccgtaaaacccgttaaaccggggaaaaacccgggaaaccgggtaacggaaacccggggtacggttaaacttaggggtttttaaactttaaggtttttaggttttacggggttttaaggttttaaccgggttttaaaactttttacgaaccggttaaaccgggtaaacggttttcccggttaaaccccgggg

SEQ ID NO: 438843 - DNA, 645 bp, Homo sapiens
  misc_feature: GZ8MTXP02GT81P.44.36.D03.1.454.CMB.2.raw
  modified_base (224)..(224): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagcctgggacgggtccctgacgactctcctgtgtcgcctctggattcaccatcagtcgaccactatagtggactcgggtcccgccgacggctacccggaagggggaacggggctgggaggttcgggacgttcggggaccgaccgaaaaggtaaaaacaaggttacgacctacgtctttactccgaacgacggtaacggtacccggaccggtcgttcgtacggttaaggaaaccgacccgacggtaacttccctaacccccgtctaacgaaagagtatacgactttacgaaaacgtaacttactatttagattcctgacgaatacgacctaaaccgtacgaaaaccgagacgacggactataggttaattagttgttagttgttagtttatagtacgacgtaactcgtaccg

SEQ ID NO: 438844 - DNA, 604 bp, Homo sapiens
  misc_feature: GZ8MTXP02JSR2C.44.36.D03.1.454.CMB.2.raw
  modified_base (377)..(377): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtcggccccaggggagacggccaggacttaccgtggtgggggcgacggccgttggaggtaaagtgtacagtggaccagcagaagccaggccagacccctgtgctggtcatctattatgatggccgggccggccctcgagtgactcccgtgccgccgcttccccgtccggctcccaactcgtacggggaaccnccgggcccaccctgacccatcgagcgaggggtcgagggccggggatcggacggccgactattacgtgtcagcgtggtgggacagtagtagtgatcgacgtcccggtggttacgttcgggacgggacgggaccgaaggccgtacggacccggttccggtacggggtccaccggtaccccgaacgggccctccggccccccgttcgggccctaccgtccgtttccccgg

SEQ ID NO: 438845 - DNA, 626 bp, Homo sapiens
  misc_feature: GZ8MTXP02HQCT7.44.36.D03.1.454.CMB.2.raw
  modified_base (304)..(304): a, c, t, g, unknown or other
  modified_base (578)..(578): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgacccactatatggactgggtccncaggctccgaggggaagggctggagtgggcttggccgacaagtaaaaacaagttcgaccagtcttatcacagagtacgccgcgttctaggtcgaaacgcccaagtacttacccaccctactacgaaagtagatcgtaacttacaaagtaacctctaaagtttcgaattttcgaggtaccgtaaattaccgaaaccttaaacccgtaggaaaaacccggtaggaaccgtacggggactaagttaggttaattagtttgtgttttagatttttaanagttaacgacggtaacttcgtaccgacgtcgggggaactaacccgggg

SEQ ID NO: 438846 - DNA, 568 bp, Homo sapiens
  misc_feature: GZ8MTXP02JKDIM.44.36.D03.1.454.CMB.2.raw
  modified_base (209)..(209): a, c, t, g, unknown or other
  modified_base (505)..(505): a, c, t, g, unknown or other
  modified_base (549)..(549): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccgggggagacttggtccagcctggaggtccctgagactctctgtgtcgcctctggattcaccatcagtcgaccactatatggactgggtcccgcaggctccgaggggagggctgggagtggctggccgacaagtaaaaacaagttcgaccagtctttagcaacgtaaggacgtaccgccgtacgtctagtagaaaacgccaagtacttccacccttgacaaaggacatcgaacttacaaagtaactcaatttgaattcagacgtaatcgaactaaacctagaaaaaccgnggaacacggggactaatgttattagttgtagttgtacgtttaanatcgaaggtactcgtaccg

SEQ ID NO: 438847 - DNA, 547 bp, Homo sapiens
  misc_feature: GZ8MTXP02GF53D.44.36.D03.1.454.CMB.2.raw
  modified_base (311)..(311): a, c, t, g, unknown or other
  modified_base (442)..(442): a, c, t, g, unknown or other
  modified_base (452)..(452): a, c, t, g, unknown or other
  modified_base (464)..(464): a, c, t, g, unknown or other
  modified_base (496)..(496): a, c, t, g, unknown or other
  modified_base (507)..(507): a, c, t, g, unknown or other
  modified_base (522)..(522): a, c, t, g, unknown or other
  modified_base (534)..(534): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtcgaccactatatggactggggtccncaggctccgaggggaggggctgggagtggcttgggccacgaaagtaaaaaacaagttcgaccagctttagcaacagagtaccgccgcgtctgtagaaagcccaagtacttcccaacccttctacaaagganatgaaccttnaaaagtaccttnatttagatttcgagacgtaatcgaactaacgngaaaaaccggngacgagctatgtatntgtgtgtattantgacgactcgacg

SEQ ID NO: 438848 - DNA, 512 bp, Homo sapiens
  misc_feature: GZ8MTXP02JNLAP.44.36.D03.1.454.CMB.2.raw
  modified_base (350)..(350): a, c, t, g, unknown or other
  modified_base (422)..(422): a, c, t, g, unknown or other
  modified_base (430)..(430): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctgggtggagtcgtgggggaggcttggtacgaggcgggggggtccctggagactctcctgtgcagcctctggattcatcttcagtgactatgccatgaactggtccgccaggctccgagggagggctggagtggttcatatgttaatnttgctggagatacccactactacgcagactctgtgaagggcattcaccaattccgaggacatcgcaagactnactgtacnctagaaattgaactagcctagagacgacgaggacacggactgtactacttcgtgtacgagacgagtcggccgacgtttacgg

SEQ ID NO: 438849 - DNA, 634 bp, Homo sapiens
  misc_feature: GZ8MTXP02JFMU4.44.36.D03.1.454.CMB.2.raw
  modified_base (353)..(353): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttcctgttgctattttagaaggtgtccactgtgaggtgcggctggtggaggtcgtgggggaggcgttggtacgaggcggggggggtcccgtgagactctcctgtgcagcctctggattcatcttcagtgactatgccatgaactcggtccgccgaggctcgagggagggctggaggtggttcatagtattatntgcgtggagactaccacctactacgcagactcgtggtacggaagggtaccgtattaccaccgtaaacttccggaagggtaaccaattaccgggaaccaaaacgggtaaacttacccgagtttacggtaactcgtaaacggtaaatacggaaacacggaccgtaggaagaacggaccgggaacgggaacccgtaacgggttctccgggtttaaacgttacctttaccggtggttacccggaagggacgtaccggtccgggggtacccctaaggttttcgggg

SEQ ID NO: 438850 - DNA, 666 bp, Homo sapiens
  misc_feature: GZ8MTXP02JL65X.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctcgaatgaacgaaaatcctacagtacatctctagaagagactaacgtttaaccatcctaccgaagaccacctacgaaaggcaggtgtcttagtatacgaccaacagtcggacctgacggacaccgagcaactattattactgtcgacgtaacgggtaatacgggaacgggaaaagaaacgagtacgtttggtttactagttaatttataacgttacttaacccgagttcgtagggacgttcggtacggggaaccgaaacggggaccctacgggtacctaacccgggttcctacccgtacgacgtccttacccgaaccggaccgggtacccctacgtttcccgggtccccttcccccggtggcccccgtaccgtcgtacccacccggagggaaccacccgtacccgtcggggtcggggaccacggccggccccgggg

SEQ ID NO: 438851 - DNA, 627 bp, Homo sapiens
  misc_feature: GZ8MTXP02IRJCH.44.36.D03.1.454.CMB.2.raw
  modified_base (309)..(309): a, c, t, g, unknown or other
  modified_base (386)..(386): a, c, t, g, unknown or other
  modified_base (484)..(484): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtcagagtgaagtgcagttggtggaggtccgggggagacttggtccagcctggagggtccctgagactctcctgtgtcgcctctggattcaccatcagtcgaccactatatggactcgggtccnccagacctccgaggggaaggggctgggagtggcttgggccgacgaaagtaaaaaacgaagttcgaccagtactttancacgagacgtacgccgcgtctgtacgaaaacgcccaagtacttacccaccccttactactaaagttagactacgtaaacttaccgaaaagtaaacctntaatttcgattcagacgtaaatcggaaacctaaaccgacgaaaaacccgaggaacgaaccggggactaaggttaagttagtttaacgttggttagtttaagttacgtttaattacgtacgtaaggtaaacttcgtaaccccgg

SEQ ID NO: 438852 - DNA, 594 bp, Homo sapiens
  misc_feature: GZ8MTXP02JLS0F.44.36.D03.1.454.CMB.2.raw
  modified_base (402)..(402): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctacagtacatctctagaagagcagtttaaccatcctaccaaggaccacctaccaaaaggcaggtggttctttagtatcgaccaacatcggaccctggccggacaccgaggcacattattactgtgacgacggggtaatcggacgggaaaagaaacngtctggtttctagtattataagttcttaccatctaggacgtcgtaggggacaaacggggccacgggtaccaccggttctcctcgacgtccttcccgaaccgacgggcccacgttcccggtccctttcccccgcggcccgtccctcgcctcccgaggaacgcctacccgtcggcggggaccacgcggtcccgg

SEQ ID NO: 438853 - DNA, 586 bp, Homo sapiens
  misc_feature: GZ8MTXP02F5TBQ.44.36.D03.1.454.CMB.2.raw
  modified_base (383)..(383): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacgttggtccagccgtggagggtccctgagactctcctgtgtcgcctcgtggattcaccatcagtcgaccactatatggactgggtcccgcaggcctccgaggggaagggctgggagtggcttgggaccgacaagtaaaaacaagttgacccagctttancacagagtaccgcgcgtctgtagaaagcccagacttacccacccgtctacaaagagatacgaacttcaaagtaaccttntattagacttcgagaactaatacgtaacctaacgtaacggaaaacccggacggaacgacggactagttagttacttagttgttaggttaagtttagttactatacgtaacgtaccgtcgtaccg

SEQ ID NO: 438854 - DNA, 626 bp, Homo sapiens
  misc_feature: GZ8MTXP02GH8XJ.44.36.D03.1.454.CMB.2.raw
  modified_base (393)..(393): a, c, t, g, unknown or other
  modified_base (457)..(457): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggagtccgggggagacgttggtccagccgtggagggtccctgagactctcctgtgtcgcctctggatcacatcagtgaccactatagtggacgtcgggtccgcgaggctccgaaggggaaggggcgtggggaggtggcgttcggccgacgaaagtaaaaaacgaagttcgaccaagtcttttancaacagacgtaccgccgcgttctagtagaaaacgccaagactttccaacccctctacaaagtanacgtgtaacttacaaagtaaccttnaattagaacttcgtagacgtaaatacgtaaacctaaaccgtaagaaaaaccggacggaacgaacgggactaaaggttacgttatttaacgttgttagttaagtttaagtttaactataacgttaacggtaacttacgtacccgg

SEQ ID NO: 438855 - DNA, 578 bp, Homo sapiens
  misc_feature: GZ8MTXP02G1UEP.44.36.D03.1.454.CMB.2.raw
  modified_base (360)..(360): a, c, t, g, unknown or other
  modified_base (382)..(382): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaagccctggagtggcttgcacacatcttctcgaatgaacgaaaatcctacagtacatctctgaagagctagtttaaccatctaccaaggaccacctacaaaggcaggtgtacttagtatcgaccaacatcggaccctgacggacaccagacacatattactgngcagggtaatggacgggaaaanaacagtcgttgtttactagtacttaataacgttacttaccattcgtagggacgtcgtaggggacgaaacgggtaccacggtccaccggtctccgtcacgtccttacccgaccgaacggcccacgtccggttccctccccgtcggcccgtccctcgcctaccgacgcgccaccgtcggcggggccacgacggcccgg

SEQ ID NO: 438856 - DNA, 600 bp, Homo sapiens
  misc_feature: GZ8MTXP02HSK7M.44.36.D03.1.454.CMB.2.raw
  modified_base (306)..(306): a, c, t, g, unknown or other
  modified_base (393)..(393): a, c, t, g, unknown or other
  modified_base (517)..(517): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggagacttggtccatcctggagggtccctgagactctcctgtgtcgcctctggattcaccatcagtgaccatatatggactgggtccncaggctccgaggggagggctggagtggcttggccgcaaagtaaaaaccaagttgaccagtctttagcaacagacgtacgccgcgtcngtagaaacgccaagtacttccacccctctacaaaggacgatacgactttacgaaagtaactctaatttgaactttcgtagaccggtaaatcggaaacccttaaaccgtaacggaaaaacccggngggaaaccgacggggactaagttacggttaatttagttagtgtttgttagtttaatacgtagtaacggtaacttcgtaacccg

SEQ ID NO: 438857 - DNA, 649 bp, Homo sapiens
  misc_feature: GZ8MTXP02IVR7Z.44.36.D03.1.454.CMB.2.raw
tcagacagtatatacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacagttgggatatataaccttgtctctgtatcaacacatccaggacaaacgccccaaatctattacttttgagtccagtgacgccggccgtgtaggttcgtttactaactcgtctttctcgtcggtccttcgtaacgtccgtcggccctacgacccggtcccttcccgtgtccgactccgttcgtcggggtccctcccgggtccgtacgggacgggaccggtaagggtccttacgggaacctttacgttacggtcgggtccggtaccttaccgttaactttacctaaccgttcgttaggacggttacggtttcgggggttcggttaccgggacgggtaaacgggtcctaccgtaaccgtccggtacccgtcgttacggaccaccggcccgtaacggtcccttccggtccccccg

SEQ ID NO: 438858 - DNA, 600 bp, Homo sapiens
  misc_feature: GZ8MTXP02FLZCG.44.36.D03.1.454.CMB.2.raw
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgctctggattcaccatcagtgaccactatagtggacgtgggtccgccaggcctccggaggggaaggggcgtgggaggtggcgttgggccgacgaaagtaaaaacgaaggttgacccagtctttancaacgagacgtaccgccgcgtctgtagaaacgccagacttccaccctctacaagagatcgacttacaaagtaactactagttgaatttccgtagacgaaagtacgaaacctaaaccgtacggaaaaacccggtaggaaccgacggggactagttacggttatttagttgttagtttggttatttaatatacgtaaggtaactcgtacccgg

SEQ ID NO: 438859 - DNA, 561 bp, Homo sapiens
  misc_feature: GZ8MTXP02FHJ3I.44.36.D03.1.454.CMB.2.raw
  modified_base (326)..(326): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagttcaggcagagtcaccatgaccaggacacgtccacgagcacagcctacatggagctgagcagtcagagactctgagacatagatgnactactgtgacgagaccggtagaggacaagacaaagaaaagtaagttcgttttagacttacgtacggggaccaaacggggtaacccgtggtaccaccggtacctacccgtacaaccgccctaccgaacccgaaacgggcccacgtccggtcccttcccccgtcggcccaccccgtcctacccgaacgaccgccaaccgtcggtcgggggaccacgacggccggcccgcgggtccg

SEQ ID NO: 438860 - DNA, 599 bp, Homo sapiens
  misc_feature: GZ8MTXP02GZSBR.44.36.D03.1.454.CMB.2.raw
  modified_base (216)..(216): a, c, t, g, unknown or other
  modified_base (303)..(303): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (394)..(394): a, c, t, g, unknown or other
  modified_base (419)..(419): a, c, t, g, unknown or other
  modified_base (449)..(449): a, c, t, g, unknown or other
  modified_base (461)..(461): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctgggagggtccctgagactctcctgtgtcgcctctggattcaccatcagtcgaccactatatggactgggtccncagggctccgaggggaagggctgggagtgggcttgggccacgaaggtaaaaacaagttcgaccagtctttancacagngtacgccgngtcngtagaaagcccagtattccaccctntacaaagagatgaacttaccaaagacctanaattgatttcgngacgaatacgaaacctaaaccgtaacggaaaaccgaggaacgacgggataagtagttaatttagttggttagtttagttagtttaactagtaacgaacggtaacgttcggtaccgtacggtcggggacccgtaacggg

SEQ ID NO: 438861 - DNA, 547 bp, Homo sapiens
  misc_feature: GZ8MTXP02JX0AV.44.36.D03.1.454.CMB.2.raw
  modified_base (309)..(309): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttgggtacgaggcgggggggtccctgagactctcctgtgcagcctctggattcatcttcagtgactatgccatgaactgggtccncgaggctccgagggagggctggagtggttccatatgttaatattgctggatactaccactactacgcagacctctgtgaacgggcctattccaacctaattcccgagggtacaagtcgaccaaagactacactagtactcgaggaaactgaacagaccgtagaacgacgacggaggaccacgggtctagtccttaacttcgtgttacggagtacggagtccggggacctacgtttggg

SEQ ID NO: 438862 - DNA, 595 bp, Homo sapiens
  misc_feature: GZ8MTXP02HLFMF.44.36.D03.1.454.CMB.2.raw
  modified_base (224)..(224): a, c, t, g, unknown or other
  modified_base (310)..(310): a, c, t, g, unknown or other
  modified_base (403)..(403): a, c, t, g, unknown or other
  modified_base (440)..(440): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagcctggagggtccctgagactctcctgtgtcgcctctggattcaccatcagtgaccactatatggactgggtccnccgaggctcgaggggaaggggctgggagtggcttgggccgacgaaagtaaaaacaagttgacctagtctttatcacagacgtacgccgcgtcngtagaaacgccaagacttaccacccttctacaaaggnaatggaactttacaaaagtacttactattgaatttccgagacgtaaatacgaaccttaaacgagaaaaaacccggagggaactacggggactagttaggttactttagttggttgtttgttacgtttaattatgaacggtaacgttcgtaacccg

SEQ ID NO: 438863 - DNA, 617 bp, Homo sapiens
  misc_feature: GZ8MTXP02J1XBM.44.36.D03.1.454.CMB.2.raw
  modified_base (317)..(317): a, c, t, g, unknown or other
  modified_base (390)..(390): a, c, t, g, unknown or other
  modified_base (439)..(439): a, c, t, g, unknown or other
  modified_base (540)..(540): a, c, t, g, unknown or other
  modified_base (596)..(596): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtcccaggcctgggacgggtccctgagactctcctgtgtcgcctctggattcaccatcagtcgaccactatagtggactggggtccnccaggcctccgaggggaggggctgggagtggcttgggccacgaaagtaaaaacaaggttcgaccagtctttancaacagagtaccgccgcgtctgtagaaacgccagtacttccaccccttntacaaagacgtatgtaaccttacgaaagtaactctaagtttgtaactttcgaggaaccgtaaagttacggaaaccttaaaaccgacggaaaaaaccccggnggaaccgaccggggactaagttaggttaattacgttggtttagttgttacgtttanacttacgagtacgtcgtaccg

SEQ ID NO: 438864 - DNA, 701 bp, Homo sapiens
  misc_feature: GZ8MTXP02F1EQW.44.36.D03.1.454.CMB.2.raw
  modified_base (269)..(269): a, c, t, g, unknown or other
  modified_base (278)..(278): a, c, t, g, unknown or other
  modified_base (359)..(359): a, c, t, g, unknown or other
  modified_base (369)..(369): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctntgatcaccntcagtgaccactatatggactgggtccgcaggctccgaggggaggggctgggagtggctggccgcaaagtaaaacagttcnccagtcttancacgagacgtacgccgcgtctgtagaaacgcccaagtacttccaacccctctacgaaagtagaatcgtaaaccttacgaaagtaaaccttcgtaatttacggaaatttcccgtaggtaaccgtaaaagttacggaaaaccccttaaaaccggttaaacggaaaaaaaacccccgggaggggtaaaaccccgaaaccgggggtaaccttaaaaggtttacggtttaaaatttttaaacggtttggttttaggtttttaacggtttacggttttttaaaacttacggtttaccgtaaaaccgggggttaaaactttccgggtttaaacccccgg

SEQ ID NO: 438865 - DNA, 622 bp, Homo sapiens
  misc_feature: GZ8MTXP02JCXFR.44.36.D03.1.454.CMB.2.raw
  modified_base (217)..(217): a, c, t, g, unknown or other
  modified_base (339)..(339): a, c, t, g, unknown or other
  modified_base (368)..(368): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccgccaggcctccgaggggagggctggagtggctggccgnaagtaaaaacaagttgaccagtctttaancacgagcgtaccgccgtcgtctgtacgaaacgccaagtacttacccaccctctacgaaagacgtatacgtaacttacgaaagtaacttctagtttagtactttcgagtacgtaaagtacgtaaaccttaaaccgtaacggaaaaccggaggaaccgacgggactaagttagttaattacgtttgttaggtttacgttagtttaatacgtaacgtaaggtaactcgtacccgtacggtcggggacccgtaacggg

SEQ ID NO: 438866 - DNA, 673 bp, Homo sapiens
  misc_feature: GZ8MTXP02G9KG2.44.36.D03.1.454.CMB.2.raw
  modified_base (310)..(310): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctggagggtccctgagactctcctgtgtcgcctctggattcaccatcagtgaccactatatggactgggtccnccaggctccgaggggagggctggagtggctggccacgaagtaaaacaagttgccagtctttatcacagagtaccgccgngtctgtagaaacgccaagacttccgaaccctctaacaagacgtatagaacctttacgaaaagtaaccttactaatttacggtaactttccgaggtaaccggtaaattacggtaaaacccctttaaaaccgtaaacgggaaaaaaaccccgggtaggggaaaacccgaaacccgggggtactaaaaggttcggtttaaacttttaacgttggtttagtttaaggtttaaatttttaaacctaagttaaccggtaaacggtaaacccgtttcggttaaacccccgg

SEQ ID NO: 438867 - DNA, 593 bp, Homo sapiens
  misc_feature: GZ8MTXP02IS1FP.44.36.D03.1.454.CMB.2.raw
  modified_base (217)..(217): a, c, t, g, unknown or other
  modified_base (302)..(302): a, c, t, g, unknown or other
  modified_base (344)..(344): a, c, t, g, unknown or other
  modified_base (377)..(377): a, c, t, g, unknown or other
  modified_base (426)..(426): a, c, t, g, unknown or other
  modified_base (435)..(435): a, c, t, g, unknown or other
  modified_base (513)..(513): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggaggtccctgagactctcctgtgtcgcctctggacttcaccatcagtgaccactatatggactgggtccnccaggcctccgaggggaacgggctgggagtggcttggccganaaagtaaaaaacaagttccgaccagtctttaancaacagacgtaccgccgcgtctgtagaaaacgccaagacttccaccctntacaagagntacgacttacaaagacttcaagtttgaattttcgagacgtaaatgaaccttaaacgagaaaaacccgggaacacgggntaagtcgtattagttgtagttgttatttaacagtaacgaaggtaacttcgtacccaacggtcggggaaccctaaccgggg

SEQ ID NO: 438868 - DNA, 585 bp, Homo sapiens
  misc_feature: GZ8MTXP02G4GV4.44.36.D03.1.454.CMB.2.raw
  modified_base (314)..(314): a, c, t, g, unknown or other
  modified_base (363)..(363): a, c, t, g, unknown or other
  modified_base (373)..(373): a, c, t, g, unknown or other
  modified_base (456)..(456): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcaggttggtgggaggtccgggggagacgttggtccagcctgggagggtccctgagactctcctgtgtcgcctctggattcaccatcagtgaccatatatggactgggtccncaggctcgaggggagggctggagtgctggccacaaagtaaaacaagtcncagtctttancacagacgtacgcgctctgagaaacgtccaagtacttcccaccctctaacaaagtagattcgaaactttcaaaagtaaccttntatttacgactttcgagacgtaatacgaaaccttaaacgaaggaaaacccgaggacgacggactagttagtttaattacgttgttagtttaacgttatttaacactacggtaaacggtactcgtaccgg

SEQ ID NO: 438869 - DNA, 992 bp, Homo sapiens
  misc_feature: GZ8MTXP02H5H5L.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttgggtggaggtccgggggagtacgttggtccaggccgtgggacgggtccctgagactctccgtgtcgtcgcctctggacttcaccatcagtcccgacactatatggacgtcgggtcccgccgaggccgtaccggaggggaaggggtctgggaggtcgggtcgttcggggacccgacgtaaaacggtaaaaaaacgtaacgggtttacgacccgtaaggttaccttttacgtaccgtaaacgtaaacggtaaccgggttaaacccccggtccccggggtacccgtttacccgggttaagggtttaaaccggaaaaaaaccgggtcccccgtaaaagggttaaccccttttacccccgtaaacccccctttaacccgttaacccgaaaaacggggtaaagggtaactttaaaccgggtaaaacccctttttaaaccggaaaaaccggtaaaacccgtttacccttaaaacgttttagggttaaaccttttaccggtaaacggtaaacccggttaaaaacgtttacccggtaaaaaaccccgtttaaaacccccggttaaaaaccgggggaaaaaaaaaacccccggggtacgggggtaaaaacccccggggtaaacccgggggaaaacctttaaacggttttaaacgggttttaaaacgtttttacggtttttaagggggttttcgggtttttaaggttttaaacgttttttaaaagtttaaaaccggtttaaacggtaaaaaccggggtttaaaacccggttttacccggtttaaaccccccggggg

SEQ ID NO: 438870 - DNA, 573 bp, Homo sapiens
  misc_feature: GZ8MTXP02FHYMC.44.36.D03.1.454.CMB.2.raw
  modified_base (186)..(186): a, c, t, g, unknown or other
  modified_base (221)..(221): a, c, t, g, unknown or other
  modified_base (397)..(397): a, c, t, g, unknown or other
  modified_base (458)..(458): a, c, t, g, unknown or other
  modified_base (557)..(557): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtntccagagtgaatgcagttggtggagtccggggganacttggtccagcctggacgggtccctgagactctcctgtgtcgcctctggatcaccatcagtcgaccactatatggactggggtcccgccgaggcctcccgaggggaaggggctggggagtggcttcgggaccgaccgaaagtaaaaaaccaaaggtttcgacccagtccttttancacagacgtaccgccgacgttctgtagaaaacgcccaagtacttccacccctctacaaagngatcgacttacaaagactcatttgatttcgtgacgtaatcgaaccttaaaccgagaaaacccgaggaccacgggcagtgtattatgttgttgtgtttanatcaaggactgtaccg

SEQ ID NO: 438871 - DNA, 592 bp, Homo sapiens
  misc_feature: GZ8MTXP02I4LQN.44.36.D03.1.454.CMB.2.raw
  modified_base (284)..(284): a, c, t, g, unknown or other
  modified_base (311)..(311): a, c, t, g, unknown or other
  modified_base (351)..(351): a, c, t, g, unknown or other
  modified_base (378)..(378): a, c, t, g, unknown or other
  modified_base (395)..(395): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccgggggagacttgggtccagccgtgggagggtccctgagactctcctgtgtcgcctctggattcaccntcagtgaccatatatggactgggtccnccaggctcgaggggaacggggctgggagtgcttggccganaagtaaaaacagttcgccagtctttancacagagtaccgccggngtctgtagaaacgccaagacttccgaccctctacgaagagacgtacgaccttacaaaagtaacctactattgtaacttctagtacgaagttacgaacctaaaccgtaagaaaacccggaaggaccgtacggggactaagttacgttactttaagttgttagtttgtagtttactatacgtacggtactcgtaacccg

SEQ ID NO: 438872 - DNA, 634 bp, Homo sapiens
  misc_feature: GZ8MTXP02FKEBV.44.36.D03.1.454.CMB.2.raw
  modified_base (309)..(309): a, c, t, g, unknown or other
  modified_base (343)..(343): a, c, t, g, unknown or other
  modified_base (432)..(432): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccaggccgtgggacgggtccctgagtactctcctgtgtcgcctctggattcaccatcagtgaccactatatggactggccncaggctcgagggaggctggagtggcttggacganaaagtaaaaacaagttcgaccagtctttagcaacagacgtacgccgtgtctgtagaaacgccaagtacttaccaccctctacaaagganatacgtaactacgaaagtactactattagtacttacgtacgtaacgtaaataaccgtaaaaccgttaaaccgtaaacggaaaacccggacgggaaccgaaacggggtacttaagttagtttaagtttagtttggttagtttagttacgttaatagtaacgtaacggtaacgtcgtaccgacggtaccggggaccgtaacggg

SEQ ID NO: 438873 - DNA, 633 bp, Homo sapiens
  misc_feature: GZ8MTXP02HI4YS.44.36.D03.1.454.CMB.2.raw
  modified_base (312)..(312): a, c, t, g, unknown or other
  modified_base (444)..(444): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagcctgggagggtccctgagactctcctgtgtcgcctctggattcaccatcagtcgaccactatatggactgggtccnccgaggcctccgagggaggggctggagtggcttggccgacaagtaaaaacaagttcgacctagtactttatccaacgacgaagtaccgccgcgttctgtagaaacgccctaggacctttcccaacccccttntaaccaaagagtactacgtacctttaacaaaacgtaccttgtatttagactttcgagaccgtaaatcggtaaaccttaaccgaacggaaaaacccggtaggaacccggacgggtactaagtttaggttactttagttggttagtttcgtttagtttaaacagttacgaacggttacttacggtacccgg

SEQ ID NO: 438874 - DNA, 570 bp, Homo sapiens
  misc_feature: GZ8MTXP02H0KP1.44.36.D03.1.454.CMB.2.raw
  modified_base (216)..(216): a, c, t, g, unknown or other
  modified_base (283)..(283): a, c, t, g, unknown or other
  modified_base (340)..(340): a, c, t, g, unknown or other
  modified_base (362)..(362): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcagtggccccaggggagacggccaggattaccnggtgggggcgacgccgttggaggtaaagtgtacagtggtaccagcagaagccaggccagacccctgngctggtcatctattatgatggcggccggccctcagtgatcccctgccgcgcttcccnccggctccaactctagggaacncggccacctcgaccatcagcagggtcgaggccggggatggaggccgtaactagttactgtcacgcgtggtggacgagttagtagtgatcgagtcccggtgttacgttcgggcgggtacggggaccaaggccgtacggacccgtccgtcggggtccaggccccaacgggtccgtaccggtcccccgtcgggtccctacttcccgtcccg

SEQ ID NO: 438875 - DNA, 598 bp, Homo sapiens
  misc_feature: GZ8MTXP02GDAWW.44.36.D03.1.454.CMB.2.raw
  modified_base (304)..(304): a, c, t, g, unknown or other
  modified_base (577)..(577): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggacccccggcagagggtcatcatctcttgttctggaagcagttccaacatcggacccttaattctgtatattggtaccagcaagtcccaggaaccggcccccaaactccncatctataggactaatcagccgccctcgacggggtccctagaccgtattctcctggcctcaagtctggcacctcacgccctcccgtggccatcacggtcgggcccccggtcggacggacggtaggttcgacttactacgtgacgcaggtccgttgggactcggacccgtccgtaggacgggtcgttggcgttcgggttcgggcgggtaagggaccaaacgtcggaccgttcgtacggtcacgacccgaaggcctccgtcccccgtcggtaccncgtcctccgttccccgtcccc

SEQ ID NO: 438876 - DNA, 644 bp, Homo sapiens
  misc_feature: GZ8MTXP02HO0PP.44.36.D03.1.454.CMB.2.raw
  modified_base (224)..(224): a, c, t, g, unknown or other
  modified_base (309)..(309): a, c, t, g, unknown or other
  modified_base (378)..(378): a, c, t, g, unknown or other
  modified_base (479)..(479): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtcagagtgaagtgcaggttggtggaggtccggggganacttggtccagcctgggagggtccctgagactctcctgtgtcgcctctggattcaccatcagtgacccatatatggactgggccnccaggcctcgaggggaagggctggagtggctggaccgagaaagtaaaaacagttcgacctagtctttancacagtacgtaccgccgagttcgagtagaaaacgccgaagtactttacccaccccttatacaaagggactaattcgaaactttaaccaaagtaacccttanagttttagaactttcgacgtaaccgaaagtttacaaaccgttaaaacccgaggaaaaaccccgggtggaaacccggtaaccgggtactaaggtttatttacgtttaagttggttttagtaaggtttaactttaatagtacgtaaacggtactttacgaacccggg

SEQ ID NO: 438877 - DNA, 556 bp, Homo sapiens
  misc_feature: GZ8MTXP02GRSDR.44.36.D03.1.454.CMB.2.raw
  modified_base (308)..(308): a, c, t, g, unknown or other
  modified_base (379)..(379): a, c, t, g, unknown or other
  modified_base (430)..(430): a, c, t, g, unknown or other
  modified_base (436)..(436): a, c, t, g, unknown or other
  modified_base (467)..(467): a, c, t, g, unknown or other
  modified_base (496)..(496): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagctctcctgtgtcgcctctggattcaccatcagtcgaccactatatggactgggtccnccaggctccgaggggaaggggctgggagtggcttgggccgcgaaagtaaaaacaagttgaccagtctttanccacagagtaccgccgtcgtctgtagaaaacgccaagacttcccacccttncaaagngactgaacttcaaagtactcatttgacttcnggacaatcgaactaaccgagaaaacccgnggaccagggacaatgtaacttgttggttgttgttgtttaacatgaacggtactcgtaccg

SEQ ID NO: 438878 - DNA, 678 bp, Homo sapiens
  misc_feature: GZ8MTXP02ICFVT.44.36.D03.1.454.CMB.2.raw
  modified_base (228)..(228): a, c, t, g, unknown or other
tcagacagtatatacacgaccggtgctcgatttagctgcgtcacgatctctcttggggtgggcacaagaggcagcactcaggacaatctccagcatggcctggtctcctctcctcctcactctcctcgctcactgcacagggtcctgggcccactctgtgctgacgcagccgccctcagtgtcgtcgggccccgggcagagggtcaccgatcctcctgcacgtgggancagatccaacagtcggacagattctgatgtcccacgtggtaacccaactaccttccgaaggaaaccaccgaccccccaaaactccctactaacttccgtttaggtaaaccaaaccttacgtcccggaccccttacggacggggttccccccctagacccgtattccgtctcggcctcccgaaagttcctcggccctaacccttcgaacgtcccctcccgtaggccctacttccgacgttcgggcccttcccgagggtcctaggaaacgagttaggaaggggttagtaattttaaacttcgtacgcccgtaagttacccttaaagtcgaacgaacgcgaacgtcccttacgtcggtttggggttggtcgggtttaccggggcggaacgggaaccctaaggtccgtcggtacccgtcccggttaggtacccgaccggtaacccgtaaccggg

SEQ ID NO: 438879 - DNA, 583 bp, Homo sapiens
  misc_feature: GZ8MTXP02JDNF4.44.36.D03.1.454.CMB.2.raw
  modified_base (222)..(222): a, c, t, g, unknown or other
  modified_base (374)..(374): a, c, t, g, unknown or other
  modified_base (377)..(377): a, c, t, g, unknown or other
  modified_base (387)..(387): a, c, t, g, unknown or other
  modified_base (413)..(413): a, c, t, g, unknown or other
  modified_base (429)..(429): a, c, t, g, unknown or other
  modified_base (438)..(438): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctgggagggtccctgagactctcctgtgtcgcctctggattcaccatcagtgaccactatatggactgggtccgcaggctccgagggaaggggctggagtggcttgggccgacgagtaaaaaccaagttgccagctttancanagagcgcgtntctagagaaacgcagacttccacctnacaagagatcgactanaaagtactntattgtattctagacgtaatacgaaacctaaaccgaacgaaaaccggacggaaccgacggggtactaagttagttaactttacgtttacggttagtttggttagttttaacgtacgttacggtaacggttaacttacggtacccg

SEQ ID NO: 438880 - DNA, 658 bp, Homo sapiens
  misc_feature: GZ8MTXP02GRFLN.44.36.D03.1.454.CMB.2.raw
  modified_base (311)..(311): a, c, t, g, unknown or other
  modified_base (380)..(380): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctctggattcaccatccagtgacccatatatggactggggtccnccgaggcctccgaggggagggctgggagtggcttggccgcgaaagtaaaaacaagttgaccagtctttncacagacgtacgcgcgttctaggtgaaaacgtcccaaaggtactttacccgaacccccttctacgaaaaggtagacttcgtaaaacctttccgaaaaggtaaccctttactaagtttagaactttccgaggtaacgtaaagttaccggtaaacccttaaacccggaaaacgggaaaaacccgggtacggaaaccgaacggggtactaagttacggttaatttacgttggtttagttaagtttagtttacacgttacgaacggtaccgttacggacccg

SEQ ID NO: 438881 - DNA, 634 bp, Homo sapiens
  misc_feature: GZ8MTXP02GSY1A.44.36.D03.1.454.CMB.2.raw
  modified_base (218)..(218): a, c, t, g, unknown or other
  modified_base (265)..(265): a, c, t, g, unknown or other
  modified_base (353)..(353): a, c, t, g, unknown or other
  modified_base (383)..(383): a, c, t, g, unknown or other
  modified_base (470)..(470): a, c, t, g, unknown or other
  modified_base (500)..(500): a, c, t, g, unknown or other
  modified_base (534)..(534): a, c, t, g, unknown or other
  modified_base (588)..(588): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagccgtggagggtccctgagactctctgtgtcgcctntggatcaccatcagtgaccactatagtggactcgggtccgccgagggctccgaggggaaggggcgtgggaggtgggcttcgggccganaaagtaaaaacaagttcgaccgagtcttancacgagcgtacgccgcgtctagtagaaacgccaaagtcttcccacccttcacaaagagtatacgtaccttaacgaaagtaaccttanatttaggaacttttcgacggaacgttaaanacgtaaaacctaaaccggtaacgaaaaacccggnggaaaccgacgggactaagttagttatttacggttgttagtttgttaagtttanatcgtaaggtaaccttgaccgtacggtccgggggacctaaccgggg

SEQ ID NO: 438882 - DNA, 570 bp, Homo sapiens
  misc_feature: GZ8MTXP02F8OC8.44.36.D03.1.454.CMB.2.raw
  modified_base (222)..(222): a, c, t, g, unknown or other
  modified_base (306)..(306): a, c, t, g, unknown or other
  modified_base (371)..(371): a, c, t, g, unknown or other
  modified_base (374)..(374): a, c, t, g, unknown or other
  modified_base (393)..(393): a, c, t, g, unknown or other
  modified_base (411)..(411): a, c, t, g, unknown or other
  modified_base (418)..(418): a, c, t, g, unknown or other
  modified_base (437)..(437): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggaggtccctgagactctcctgtgtcgcctctggattcaccatcagtgaccactatatggactgggtccncaggctccgagggaagggctgggagtggcttgggccgcaagtaaaaacaagttcgacagctttancanagacgtcgcgtgtctaganaacgcagtactccacctnacaaganatacgtactacaaatactntattcgacttcgagacgtaagtacgtaaacctaaaccgtaacggaaaaccggacggaaccgaacgggtactaagttagttacttagttggttagttaagttagtttaactactacgtaacggtactcgtaccg

SEQ ID NO: 438883 - DNA, 650 bp, Homo sapiens
  misc_feature: GZ8MTXP02G312Z.44.36.D03.1.454.CMB.2.raw
  modified_base (318)..(318): a, c, t, g, unknown or other
  modified_base (390)..(390): a, c, t, g, unknown or other
  modified_base (420)..(420): a, c, t, g, unknown or other
  modified_base (485)..(485): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttgggtccagcctgggacgggtccctggagactctcctgtgtcgcctctggattcaccatccagtcgaccactatagtggactcgggtcccnccgaggctccggaggggaaggggctgggagtggcttggccgaccgaaagtaaaaacagttgccagtctttancacagacgtacgccgcgtctgtacgaaacnccgagtacttcccgaacccctcgtacaaagacgtatacggtaaaccttacgaaaagtaacccttntaaagtttcggtaaactttccgtaggaccgttaaatacggaaaccttaaaccgtaaacgggaaaaccgacgggaaccgtaacggggactaaggtttacgtaactttacgttagtttaagtttggttagtttaaatacgttaccgaaggttaccttcgtaacccgg

SEQ ID NO: 438884 - DNA, 710 bp, Homo sapiens
  misc_feature: GZ8MTXP02FHAET.44.36.D03.1.454.CMB.2.raw
  modified_base (269)..(269): a, c, t, g, unknown or other
  modified_base (374)..(374): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctgggagggtccctgagactctcctgtgtcgcctntggattcaccatccagtgaccactatatggactgggtccgcaggctccgaggggagggctgggagtggcttggcgacaagtaaaaacaagttcgaccagctttancaacagagtaccgccgtacgtctaggtagaaaacgtcccaaagtactttacccaaccccctctaaccgaaaaggtccggtaaatacgggtaaaccctttacgaaaacggtaaaacccttcgaaagttttcgggtaaacttttcccgtaggaacccggttaaaatacggtaaaaccccttaaaacccgtaacgggaaaaaaacccccgggaggggtaacccgaaaccgggggactaaggttacggttaaacttttaagttggtttaggtttaacggtttaaggtttttaactaaaggtttcccgaaaagggggttaaaccttcggttaaacccccgg

SEQ ID NO: 438885 - DNA, 581 bp, Homo sapiens
  misc_feature: GZ8MTXP02I4G6C.44.36.D03.1.454.CMB.2.raw
  modified_base (378)..(378): a, c, t, g, unknown or other
  modified_base (477)..(477): a, c, t, g, unknown or other
  modified_base (511)..(511): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctggagggtccctgagactctcctgtgtcgcctctggattcaccatcagtcgaccactatatggactgggtcccgccaggctccgaggggagggctgggagtggctggccgacaaagtaaaaacaagttcgacctagtctttancaacagacgtaccgccgcgtctgtagaaacgcccaagactttcccaccccttctacaaagagatcgaactttacaaagtaacctctaattgaatttcgngacaatacgaacctaaacgtacggaaaaacccgnggaaccgacgggctaagttgtaatttagtttgttgtttgttagtttactagttcgaaggtactcgtaccg

SEQ ID NO: 438886 - DNA, 595 bp, Homo sapiens
  misc_feature: GZ8MTXP02JY8TH.44.36.D03.1.454.CMB.2.raw
  modified_base (382)..(382): a, c, t, g, unknown or other
  modified_base (433)..(433): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtggacgggtccctgagactctcctgtgcgcctctggattcaccatcagtcgaccactatatggactgggtccgccaggctccgaggggaaggggctgggagtggcgttgggccgacaaagtaaaacaagttgccagtctttancaacagacgtacgccggtcgtctgtagaaacgccctaagccttcacccctntacgaaagacgatcgaacttacaaacgtacctacattgtaatttcgtagaccgtaaatacgtaaacctaaaccgtaagaaaaacccggcggaaacgacggactagttagttaacttagttgttgtttaagttagtttaatacgtacgacggtactcgtaccg

SEQ ID NO: 438887 - DNA, 695 bp, Homo sapiens
  misc_feature: GZ8MTXP02GQPWQ.44.36.D03.1.454.CMB.2.raw
  modified_base (275)..(275): a, c, t, g, unknown or other
  modified_base (517)..(517): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagacgttggtccagccgtgggacgggtccctgagctctcctgtgtcgcctntggattcaccatcagtcgaccactaatagtggacgtcgggtcccgccgaggcctaccggaaggggaacggggcgtgggaggtggcgttcgggccgaccgaaagtaaaaacgtaaggttcgacctagtactttagaccaacgaggacgtaccgccgtcgttacgtgtagaaaacgtcccaaggtacttacccaccccttctacgaaagacgattacgaaacctttaccgaaaagtacctttanaatttgtaacttcgtaggaacgtaaagtaccgtaaacccttaaaaccgaaaacggaaaaacccggacggtaaacccggtaacgggtaactaagttaaggtttaacgtttagtttaggtttagtttaaggtttacgtttaaagtacgttacggtaaacggttaactttaccggtacccg

SEQ ID NO: 438888 - DNA, 680 bp, Homo sapiens
  misc_feature: GZ8MTXP02F2UY7.44.36.D03.1.454.CMB.2.raw
  modified_base (401)..(401): a, c, t, g, unknown or other
  modified_base (451)..(451): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctgagcttgggttttcctgttgttattttacaggtgtccagagtgaagtgcaggttgggtggaggtccgggggatacgttgggtccaggtcccgtgggacgggttcccctggacgtaccttctccctggtcgtccgcctcgtggattccaccatcagtcgaccatatagtggacgtgggtcccgcaggcgtcggaggggacgggctggagtggctggccgacgaaacgtaaaaacagttcacagtcttancaacgagacgtacgcgtcgtctagtagaaacgcaagtacttaccaccctntacaaagatancgtaacttacaaagtaccttgtaacgtttagtatttccgtaggtaaccgtaaagttaccggtaaaccttaaaacccggtaaaccgggaaaaaccccgggtagggaaaccccggtaacgggtaccttaaaggttaggttttaacttttaggtttggtttagtttaagggtttaactttaaagtacgttacgaaacgggttaaccttcggttaaacccgg

SEQ ID NO: 438889 - DNA, 604 bp, Homo sapiens
  misc_feature: GZ8MTXP02FUH0M.44.36.D03.1.454.CMB.2.raw
  modified_base (316)..(316): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctggtggagtcgtgggggaggcttgggtacgaggccgggggggtccctggagactctcctgtgcagcctctggattcatcttcagtgtactatcgccatcgaacgtgggtccnccgaggcctccgaggggagggctggtaggttggtttacagttatagttaatatgctgggatactaccacctactacgcagactgtaggtgaacgggcctatacacctaagttcccgaagggtaccaagtcgaaccaaagactacacttgtaactacgtaggtaaactggaaacacgtaccgtaggaacgaacggacggtaacggaccgtaaccgggtcttacggttaccttaacgtttcgtaagggttaccgaaggtacggacgttccggggaccttaggtttacggg

SEQ ID NO: 438890 - DNA, 614 bp, Homo sapiens
  misc_feature: GZ8MTXP02H5B2M.44.36.D03.1.454.CMB.2.raw
  modified_base (217)..(217): a, c, t, g, unknown or other
  modified_base (278)..(278): a, c, t, g, unknown or other
  modified_base (381)..(381): a, c, t, g, unknown or other
  modified_base (387)..(387): a, c, t, g, unknown or other
  modified_base (408)..(408): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagactctctgtgtcgctctggatcaccatcagtnaccactatatggactcgggtccgccgaggcctccgaaggggaaggggcgtgggaggtgggcgttgggccgacgaaagtaaaaacaagttcgaccagtctttancacagngtacgccgcgtctgtagaaanccaagtactaccaccctcacgaagagatagtaacttacaaagaactactatttagatttcagacgtaaatacgaaacctaaaccgtaacggaaaaaccgaggaaccgaacgggactaagtagttattaagtttgtagtttagttagttttaactattaacgtaaggaaaccttcggaccgtacggtacgggggaccctaacggggg

SEQ ID NO: 438891 - DNA, 626 bp, Homo sapiens
  misc_feature: GZ8MTXP02HNYVM.44.36.D03.1.454.CMB.2.raw
  modified_base (401)..(401): a, c, t, g, unknown or other
  modified_base (473)..(473): a, c, t, g, unknown or other
  modified_base (498)..(498): a, c, t, g, unknown or other
tcagacagtatatacacgaccggtgctcgatttagctgcgtcacgatctctcttggggagctctgagagcggagccccagccccagaattcccaggtgttttcattttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtcgaccactatatggactcgggtcccgccgaggcctaccggaaggggaaggggcgtgggaggtggcgttcgggccgacgaaagtaaaaaacctaaggttcgaccctagtactttanccaacagtacgtaccggcccgcgttcgtagtacgaaaacgcccaaggtactttcccacccctctacgaaagngatgaactttaccgaaagtaccttnaatttgatttcgagacaatcgaaacctaaccgtaagaaaaccggaggaacgacgggactaagttagttatttagttggttgtttaaggtttattttaatacttacgtaacggtactttacgtacccgg

SEQ ID NO: 438892 - DNA, 558 bp, Homo sapiens
  misc_feature: GZ8MTXP02FMOO5.44.36.D03.1.454.CMB.2.raw
  modified_base (299)..(299): a, c, t, g, unknown or other
  modified_base (369)..(369): a, c, t, g, unknown or other
  modified_base (385)..(385): a, c, t, g, unknown or other
  modified_base (419)..(419): a, c, t, g, unknown or other
  modified_base (439)..(439): a, c, t, g, unknown or other
  modified_base (459)..(459): a, c, t, g, unknown or other
  modified_base (486)..(486): a, c, t, g, unknown or other
  modified_base (523)..(523): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggtttccttgtgttatttacaaggtgtccagagtgaagtgcagttggtggagtccgggggagacttgggtccagcctggagggtccctgagactctcctgtgtcgcctctggattcaccatcagtgaccatatatggactgggtccnccaggctccgaggggaaggggctgggagtggcttgggccgacaagtaaaaacaagttcgaccagctttancacagacgtacgccgngtcctgtagaaaacgcccaagactttccaccctntacaaagacgatgaacttanaaagaacttcattgatttcngacgaatcgaactaaactgaaaaccgngaacgagggcatgtattagttcgtagttgtactttanattcgaaggtactgtccacgtggggaccaacgggg

SEQ ID NO: 438893 - DNA, 848 bp, Homo sapiens
  misc_feature: GZ8MTXP02HWDLI.44.36.D03.1.454.CMB.2.raw
  modified_base (202)..(202): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgngtaggttgggtagggacgggtacgggggagttacggttcggtaccgacggtccggtaggggtaccgggtcccgtaggacgtccttccgtccgtggttcgtccgtcccgttcgtaggtaccttaccaacctactacgtacgtaccgaaccctaattaagtaggtacggtaccgggttccgggcccgaccggacggtcccgtaaccggggaagggggacggggtcggtagggaggtcggtcggtaccggaccgaacgtaaaaacgtaaaaacgtagtacgacgtacgttacttacacgaagacggtacgtaccgtcgtcgttacgtagaaacgaaaccgtccgaaacgttacccttacccctacccgttacaaacgaaaggtaacgttacgtaacttaaaccttaaacggaaaacgttacccttagtttaagttacggttaactttcggaacggaaacgttaacgtaaccgttaaaaccccgttaaacggaaaaaaccgggtaaaaccgggtaacgggaaacccggtaaccgggaacttaaggggtttaacttttaaaagtttcggttttgggtttagttttaacgggttttaagtttaaaaccttggtaaaccggtaaaccggttacgtttacccggaaccccgggg

SEQ ID NO: 438894 - DNA, 579 bp, Homo sapiens
  misc_feature: GZ8MTXP02ID7WA.44.36.D03.1.454.CMB.2.raw
  modified_base (222)..(222): a, c, t, g, unknown or other
  modified_base (267)..(267): a, c, t, g, unknown or other
  modified_base (303)..(303): a, c, t, g, unknown or other
  modified_base (365)..(365): a, c, t, g, unknown or other
  modified_base (368)..(368): a, c, t, g, unknown or other
  modified_base (381)..(381): a, c, t, g, unknown or other
  modified_base (410)..(410): a, c, t, g, unknown or other
  modified_base (490)..(490): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggganacttggtcagcctggagggtccctgagactctcctgtgtcgcctnggattcaccatcagtgaccatatatggactgggccncgaggctaccgaggggagggctggagtggctggcgacaagtaaaaacagtgacagtctttancanagagtaccgccgngtctgtagaaacgccagacttccaccctntacaagagatgtacttcaaagtactatagttgtaattccgtagacgtaatacggaaacctaaccgtaacgaaaaacccgnggaaaccgacgggactaaagtacgtttaattagtttagttaggtttaagttaggtttaataccgtagtacggtaaacttcggtaacccg

SEQ ID NO: 438895 - DNA, 603 bp, Homo sapiens
  misc_feature: GZ8MTXP02GDZ3Z.44.36.D03.1.454.CMB.2.raw
  modified_base (271)..(271): a, c, t, g, unknown or other
  modified_base (311)..(311): a, c, t, g, unknown or other
  modified_base (390)..(390): a, c, t, g, unknown or other
  modified_base (437)..(437): a, c, t, g, unknown or other
  modified_base (526)..(526): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtacagttggtggaggtccgggggagacttggtccagcctgggagggtccctgagactctcctgtgtcgcctntggattcaccatcagtgaccatatagtggactggggtccncgaggcctccgaggggagggcgtgggaggtggcgttgggccgacgaaacgtaaaaaacaagttcgaccgtagtctttancacgagacgtaccgccgcgtctgtacgaagccagtacttccaccctnacaaagagatacgacttaacgaaagtaacctctaagttgactttccgagacgtaatacggtaaacctaaaccgtaacgaaaaacccggnggaaccgacgggctaagttagttatttagttgttagtttgttaacgtttatacgtcgaagtacttcgaccgtacggg

SEQ ID NO: 438896 - DNA, 672 bp, Homo sapiens
  misc_feature: GZ8MTXP02HXBCA.44.36.D03.1.454.CMB.2.raw
  modified_base (307)..(307): a, c, t, g, unknown or other
  modified_base (387)..(387): a, c, t, g, unknown or other
  modified_base (452)..(452): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggagggtccctgagactctcctgtgtcgcctctggattcaccatcagtgaccactatagtggactggggtcccnccgaggcctccgaggggaaggggctgggaggtgggcgttgggccgacgaaagtaaaaacaaggttcgacctagtctttancacagcgtacgccgtcgtcgtagtagaaacgcccaagtacttcccacccttctaaccgaaagtanacgttacgtaaccgtttacaaaacgtaaccttacttaagtttgtacttttacgacggtaccgaaaattcggaaaaccttaaaccgtaacggaaaaaacccggaggaaccgaaccggggactaagttagtttaatttaagtttcggttagttttagttagttttaacagttaacggaacggtaactcggtaccgtacggtcgggggtaccccaaacggggg

SEQ ID NO: 438897 - DNA, 691 bp, Homo sapiens
  misc_feature: GZ8MTXP02IOC1X.44.36.D03.1.454.CMB.2.raw
  modified_base (224)..(224): a, c, t, g, unknown or other
  modified_base (312)..(312): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaaggtgtccagagtgaagtgcaggttggtggagtccggggganacttggtccagcctgggagggtccctgagctctcctgtgtcgcctcgtggattcaccatccagtcaccactatatggactgggtcccnccgaggctccgaggggaacggggctgggagtgggccgttgggcccgacgtaaagtaaaaacctaaggttcgacctaagtcttttagtccaaacgaggacgttacccggccggtcgttctggtaggaaaacgcccaagtactttcccaacccccttctacaaaggaagtactacgtaaacctttaccgaaaagtaaccttctaatttggtaaactttccgtggtaaccgtaattacggtaaaacccttaaaacccgtaaaggaaaaacccccggtaggggaacccgaaccgggggtactaaagttaggttaacttttagtttggtttagtttaagtttaggtttttaactagttcgaaacggttaccttacgggtacccg

SEQ ID NO: 438898 - DNA, 774 bp, Homo sapiens
  misc_feature: GZ8MTXP02ITU2N.44.36.D03.1.454.CMB.2.raw
  modified_base (224)..(224): a, c, t, g, unknown or other
  modified_base (312)..(312): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggagtccggggganacttggtccagcctggagggtccctgagactctcctgtgtcgcctctggattcaccatcagtcgaccactatatggactggggtcccnccgaggcctccgaggggaggggctgggagtggcttggccgacaagtaaaaacaagttcgacctagtctttagcacagacgtaccgccgcgttctaggtagaaacgcccaagtactttcccaacccccttctaacgaaaaggtacgtaacttacggtaaacccttttaacgaaaacggtaaaaccctttgttaaacgttttacgtaactttaccgtaacgggtaaccgttaaaacgttaaccggtaaaaccccgttaaaacccggtaaaacgggaaaaaacccccgggtacggggaaaaccccggtaaaccgggggttaaccttaaaggtttaacggttttaaacgtttttaacgggttttacggttttaacgggtttttaacgggttttaaacggtttttaaaacgtttaaacggttaaccgggttaaaacggggtttaacccgtttacggttaacccccgg

SEQ ID NO: 438899 - DNA, 632 bp, Homo sapiens
  misc_feature: GZ8MTXP02FIFOG.44.36.D03.1.454.CMB.2.raw
  modified_base (286)..(286): a, c, t, g, unknown or other
  modified_base (382)..(382): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtcgtcgcccctggattcacatcagtnaccactatatggactggggtccgccgaggcctccgaggggaaggggctgggaggtggcttgggccgacgaagtaaaaacaagttgccagtctttancacagagtacgccgctctgtagaaacgccaagacttccacccttcacaaagagatagacttacgaaagtaaactcaattcgaatttctacgacggtaattacggaaacccttaaaaccgtaacggaaaaaacccggagggaaaacccgacgggggtaacctaaagttacggttaactttaacgtttggttagttttaggttaagttttaatacgttacgaagggtaaaaccttcggtacctaaccggggg

SEQ ID NO: 438900 - DNA, 660 bp, Homo sapiens
  misc_feature: GZ8MTXP02GHRFN.44.36.D03.1.454.CMB.2.raw
  modified_base (333)..(333): a, c, t, g, unknown or other
  modified_base (401)..(401): a, c, t, g, unknown or other
  modified_base (404)..(404): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgctaggttgggtggaggtccgggggatacgtttgggtccaggcccgtgggacgggttcccctggacgaccttctccgtgtgtccgcctcgtggattcaccatcagtcgaccactatagtggacgtgggtcccncgaggctccggaggggagggctgggagtggcgttggccgacaaagtaaaacaagtcgacagtctttancanagacgtaccgcgcgtctagtagaaacgccaagtacttcccacccgtctacgaaagtagatcgtaaaccttacgaaaagtaccttactaagtttaggtactttcgagtaaccgtaataccggtaaaaccttaaacccgtaaacggaaaaacccggtacggaaaccgacggggtactaagtttaacgtttacttttacgttggtttacgtttaagtttagtttaatacgttacgaacggttacgttcgttaacccggg

SEQ ID NO: 438901 - DNA, 631 bp, Homo sapiens
  misc_feature: GZ8MTXP02H6B7U.44.36.D03.1.454.CMB.2.raw
  modified_base (323)..(323): a, c, t, g, unknown or other
  modified_base (414)..(414): a, c, t, g, unknown or other
  modified_base (513)..(513): a, c, t, g, unknown or other
  modified_base (567)..(567): a, c, t, g, unknown or other
  modified_base (613)..(613): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagcttgggttttccttgttgttatttacaaggtgtccagagtgaagtgcagttggtgggaggtccgggggagtacgttggtccagcccgtgggacgggtccctggagactcgtcctgtcgtcgcctctggacttcaccatcagtcgaccatatagtggacgtcgggtcccnccgaggcctaccggaggggaacggggcgtagggaggtcggcgttgggaccgacaaaagtaaaaaaccaaggttcgacctaagttcctttanccgtaaacaggtacgtacccgcccgacgttcgtagtaagaaacgccaagtactcccacccttctacgaagagtatacgtaacttacgaaagtaaccttnaaagttgtacttcgtaggacgtaaatcgtaaacctaacgtaacgaaaaaccggngtaaccgacggactagtagttattagttgtagtttgttagttaatntacgacgtactcgtaccg

SEQ ID NO: 438902 - DNA, 578 bp, Homo sapiens
  misc_feature: GZ8MTXP02GLIMV.44.36.D03.1.454.CMB.2.raw
  modified_base (270)..(270): a, c, t, g, unknown or other
  modified_base (377)..(377): a, c, t, g, unknown or other
  modified_base (427)..(427): a, c, t, g, unknown or other
  modified_base (449)..(449): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctggagggtccctgagactctcctgtgtcgcctntggattcaccatcagtgaccactatatggacgtgggtccgccgaggctccgaggggaaggggctgggagtggctggccgcaagtaaaaacaagttgaccagctttancacagagtaccgcgcgtctgtagaaacgcccaagtacttcccaacccctntacgaaagagatgaacctttanaaacgtactcattgatttacctgacgtaaattcgaaaccttaaaccgtaggaaaaacccgacggacgacggggacaagttagtatttagttgttagttgttatttactatacgaggtaacttcgtaccg

SEQ ID NO: 438903 - DNA, 649 bp, Homo sapiens
  misc_feature: GZ8MTXP02F0MVP.44.36.D03.1.454.CMB.2.raw
  modified_base (286)..(286): a, c, t, g, unknown or other
  modified_base (306)..(306): a, c, t, g, unknown or other
  modified_base (343)..(343): a, c, t, g, unknown or other
  modified_base (371)..(371): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacttggtccaggcctgggacgggtccctgagactctcctgtgtcgcctctggattcaccatcagtnaccatatatggactgggccncaggctccgaggggagggctggagtggctgggccganaagtaaaaacagttcgaccagtctttancaacaggacgtacgccgtcgtacgtagtacgaaaacgcccaagtacttacccacccttactacaaagagtactacgtaacttacaaaagtaactactaagttagtactttcgtagtacgtaaatacggtaaacctaaaccgtaacggaaaaacccggagggaaacccgacggggtactaacgttagtttaaatttagtttaggttgttttacgtttagtttaactagtaacgtaaggtaacttcggtaccgacggttaccgggggacctaaccggggg

SEQ ID NO: 438904 - DNA, 622 bp, Homo sapiens
  misc_feature: GZ8MTXP02IH8ZX.44.36.D03.1.454.CMB.2.raw
  modified_base (276)..(276): a, c, t, g, unknown or other
  modified_base (315)..(315): a, c, t, g, unknown or other
  modified_base (533)..(533): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggaggtccgggggagacgttggtccagccgtgggacgggtccctgagtactctcctgtcgtcgcctntggattcaccatcagtgaccatatatggactcgggtccnccaggctccgaggggaggggctggagtgcgtggccacaaagtaaaaacagttcgactagtactttagcaacgagacgtaccgccggtctcgtagtagaaacgccaagtacttcccaccctctacaacgagtactacgtactttacgaaagtaacttactatttagtactttcgtacgaacgtaatacgtaaaccttaaccgtaaaggaaaaacccggnggaaaccgacggggaactagttagtttaatttagtttgttagtttaagttgtttaaattacgtacgtaacggtaaccttggtaacccgg

SEQ ID NO: 438905 - DNA, 543 bp, Homo sapiens
  misc_feature: GZ8MTXP02FP2WB.44.36.D03.1.454.CMB.2.raw
  modified_base (366)..(366): a, c, t, g, unknown or other
  modified_base (474)..(474): a, c, t, g, unknown or other
  modified_base (498)..(498): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggagggctggagtggcttggccgcaagtaaaaacaagttcgccagctttancacagagtacgccgcgtctgtagaaacgccagacttccaccctctacaaagacgatgacttcaaacgactctattgacttctgacgaatcgaactaactagaaaacgnggacacgggctagtgtattatgtnttgtagttatatcgaggtaactgtccaacgtcggggaccaacggg

SEQ ID NO: 438906 - DNA, 789 bp, Homo sapiens
  misc_feature: GZ8MTXP02IJCVN.44.36.D03.1.454.CMB.2.raw
  modified_base (211)..(211): a, c, t, g, unknown or other
  modified_base (225)..(225): a, c, t, g, unknown or other
  modified_base (252)..(252): a, c, t, g, unknown or other
  modified_base (312)..(312): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaaggtgtccagagtgaagtgcgaggttggnggagtccggggganacgttggtccagcctggaggtcctganctctcctgtgtcgcctctggattcacatcagtcgaccactatagtcggacgtgggtcccnccgaggccgtaccgaggggaacggggctgggagtgggtctttcgggccgtacgaaaggtaaaaaccaaagtttcggaccctaggtactttttacgacctaacgaacgggtacgttaaccggcccggtccggttaccctagggttaacgaaaaccgtcccgtaaaggtactttacccgaaaccccccttagttaacccgaaaaggtaacgtaattacggtaaaccttttacccaaaaagggtaaaacccttccgtaaatttcgggaaacttttcccggtaagacccgggtaaaattcggtaaaaccctttaaaaccggaaacgggaaaaaaacccccggaggggttaaacccaacgggggtaaaccttaaaagtttcggttaaaacgtttaaggtttgggtttagtttaagtttacccgggttttaaactagttaacccgtaaaacggggtttaaacccctggtttaaacccccgggg

SEQ ID NO: 438907 - DNA, 675 bp, Homo sapiens
  misc_feature: GZ8MTXP02GRK1R.44.36.D03.1.454.CMB.2.raw
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgacccactatatggactggggtcccgccagggcctccgaggggaaggggctggggagtgggcgttggccgacaaaggtaaaaacaagttcgaccagtctttaatcaacagacgtaccgccgcgtctgtagaaacgcccaagtacttcccaccctcgtacaaagagtactcgtaacctttacaaagaaccttctaagtttagactttaccgtaggtaacggtaaattacggtaaaacccttaaaccgtaaaccggaaaaaaccccgggagggaaacccgacgggggtaacctaaagtttggttaaattttagttgggtttgtttgtttaacgttttaatacgttccgaaagggtaaccttcggtaccctacgggtccgggggacctaacccggggg

SEQ ID NO: 438908 - DNA, 703 bp, Homo sapiens
  misc_feature: GZ8MTXP02I1W0C.44.36.D03.1.454.CMB.2.raw
  modified_base (277)..(277): a, c, t, g, unknown or other
  modified_base (400)..(400): a, c, t, g, unknown or other
  modified_base (497)..(497): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgctaggttggtggaggtccgggggagtacgttggtccagccgtggacgggtccctgagactctcctgtcgtcgcctntggatcaccatcagtcgaccactatagtggacgtcgggtccgccgaggcctaccggaaggggaaggggctgggagtggcgttgggccacgaaagtaaaaacgtaagttcgaccagttctttancaaacgaggtacgtaccgcccgtgttcgtagtacgaaaacgcccgtaagtacctttcccgaacccttcaacgtaaagagtactacgtaaacctttanaaaacgtaacttcgtaatttgtaactttccgtagaacctaaagtcggaaaccttaaaaccgtaaacgaaaaacccgggtaggaacccgtaaaccggggtactaaagtttacgtttaaacttttaaggtttcggtttaaggttttaagttttaaggttttaaactaggttaacccggtaaaggttaaccgtttcgttaacccccggg

SEQ ID NO: 438909 - DNA, 599 bp, Homo sapiens
  misc_feature: GZ8MTXP02IL32F.44.36.D03.1.454.CMB.2.raw
  modified_base (210)..(210): a, c, t, g, unknown or other
  modified_base (224)..(224): a, c, t, g, unknown or other
  modified_base (273)..(273): a, c, t, g, unknown or other
  modified_base (311)..(311): a, c, t, g, unknown or other
  modified_base (384)..(384): a, c, t, g, unknown or other
  modified_base (454)..(454): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggnggaggtccgggganacgttggtccagccgtgggacggtcctgagactctcctgtgtcgcctcnggattcaccatcagtcgaccatatagtggactgggccnccgaggctccgaggggagggctgggagtggcttgggccgacaaagtaaaaacaaggttgacctaagtctttancaacgagacgtaccgccgcgttctgtagaaaacgcccaagtactttacccaacccctctaacgaaagatntacgtacctttacaaagtacttcatttcgatttcgagacgtaaatgtaaacctaaccgtagaaaaacccgtggaacgacgggactagttagttatttagttgttgtttgttacgtttaatcgtagtacggtaacttcggtacccg

SEQ ID NO: 438910 - DNA, 656 bp, Homo sapiens
  misc_feature: GZ8MTXP02JEM7C.44.36.D03.1.454.CMB.2.raw
  modified_base (315)..(315): a, c, t, g, unknown or other
  modified_base (387)..(387): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggaggtccgggggagacgttggtccaggccgtgggagggtccctgagactctcctgtgtcgcctctggattcaccatcagtcgaccatatatggactcgggtccncaggctccgaggggaaggggctgggagtggcgttgggccgacgaagtaaaaacaagttcgaccagtctttanccaacgagtacgtacgccgacgtctggtagaaacgccaagtacttcccaacccctctacgaaaaggtagactcgtaaaccttacaaaaggtaacttctaatttcggaaattttcgacggactaaaagttcgtaaacccgttaaacctaacggaaaaacccggagggaaaccgaaccggggactaaagttacggttaatttacgtttggttaggtttaagtttacgttttaaatacttaccgaaaggggtttaaccttggttaaccccgg

SEQ ID NO: 438911 - DNA, 651 bp, Homo sapiens
  misc_feature: GZ8MTXP02G9Z92.44.36.D03.1.454.CMB.2.raw
  modified_base (273)..(273): a, c, t, g, unknown or other
  modified_base (373)..(373): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtggacgggtccctgagactctcctgtgtcgcctntggattcaccatcagtcgaccactatatggactgggtccgccaggcgtcgaggggaggggctggagtgcgtggccgacaagtaaaaacagtgcagtcttncacagacgtacgccgngtctgtagaaacgccagtacttcccgaccctctaacgaaagagactagtaacttacgaaaacgtacttacgtattagtactttaccgtagacgtaaaactcggtaaaaccttaaaaccgaacggaaaaaccccggaagggtaacccggtaaacggggacctaaagttaacggttacgttttaacgtttggtttaacggttttaaggtttaagtttttaagttaacttacggtaaacggttaacctttacggtaacccccggg

SEQ ID NO: 438912 - DNA, 700 bp, Homo sapiens
  misc_feature: GZ8MTXP02IW7Y7.44.36.D03.1.454.CMB.2.raw
  modified_base (224)..(224): a, c, t, g, unknown or other
  modified_base (299)..(299): a, c, t, g, unknown or other
  modified_base (314)..(314): a, c, t, g, unknown or other
  modified_base (416)..(416): a, c, t, g, unknown or other
  modified_base (500)..(500): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctgagctgggttttccttgttgttattttacaaggtgtccagagtgaagtgcagttggtggagtccggggganacgttggtccagcctgggagggtccctgagactctcctgtgtcgctcgtggattcaccatcagtcgaccactatntggacttgggtcccnccgaggctaccgaggggaacggggctggggagtcggcgtttcgggcccgtagtaaaacggtaaaaaacctaaaggtttcgaccccgtaaggtcctttttaanccgaacgacggtaaccgtcccggaccggtcgttcgtaggtacgaaacgccgtaagtacttacccaccctcgtaacgaaaggtanatacgtaaaccttaacgaaaacgtaacttactagttacgtactttcgtaggaacgttaaacgtacgtaaacccgttaaaacgtaaaccggaaaaacccggtaggaaccggaacgggttactaaaggttagtttaacgtttacgtttggtttagtttgtttagtttaacgtacgtacggtaaacggttacctacggtaccg

SEQ ID NO: 438913 - DNA, 534 bp, Homo sapiens
  misc_feature: GZ8MTXP02F85EM.44.36.D03.1.454.CMB.2.raw
  modified_base (374)..(374): a, c, t, g, unknown or other
  modified_base (395)..(395): a, c, t, g, unknown or other
  modified_base (414)..(414): a, c, t, g, unknown or other
  modified_base (421)..(421): a, c, t, g, unknown or other
  modified_base (448)..(448): a, c, t, g, unknown or other
  modified_base (476)..(476): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaggggctgggagtggcttggccgcaagtaaaaacaagttgaccagctttancacagagtacgcgcgtctgtnaaagccagattccaccctntacaagngatgacttcaaagaactcattgattcngcgaatgaacctaacctagaaaacccgnggaacacgggctaagtagtattagttgtgttgtgtttactatcgaggtaactgtaccg

SEQ ID NO: 438914 - DNA, 642 bp, Homo sapiens
  misc_feature: GZ8MTXP02G3WL6.44.36.D03.1.454.CMB.2.raw
  modified_base (461)..(461): a, c, t, g, unknown or other
  modified_base (482)..(482): a, c, t, g, unknown or other
  modified_base (536)..(536): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctctggacttcaccatcagtgaccactatagtggactggggtcccgccgagggcctccggaggggaacggggtcgtgggaggtgggcttcgggacccgacgaaaggtaaaaaactaaggttcgacccagtctttaatccaacgagcgtaccgccgcgtcgtagtagaaacgcccagacttcccaacccttcacaagganatcgaacttacaaagacctanagtttgaactttctacgacgtaactacggtaacctaaaccgaaggaaaacccgnggaaccgtagggctaagttagttaatttagttggttagtttcgttagtttaatagtaaccgtaaaggtaaccttcgtaccgacgggtcggggaaccgaacccgggg

SEQ ID NO: 438915 - DNA, 538 bp, Homo sapiens
  misc_feature: GZ8MTXP02JHEU0.44.36.D03.1.454.CMB.2.raw
  modified_base (374)..(374): a, c, t, g, unknown or other
  modified_base (423)..(423): a, c, t, g, unknown or other
  modified_base (431)..(431): a, c, t, g, unknown or other
  modified_base (452)..(452): a, c, t, g, unknown or other
  modified_base (463)..(463): a, c, t, g, unknown or other
  modified_base (470)..(470): a, c, t, g, unknown or other
  modified_base (479)..(479): a, c, t, g, unknown or other
  modified_base (488)..(488): a, c, t, g, unknown or other
  modified_base (522)..(522): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtcgaccactatatggactgggtcccgcaggcctcgagggaggggctggagtggcttggccgacaagtaaaaacagttcgccagtctttancaacagacgtaccgccgcgtctgagaaacgcccaagtacttccaccctntacgaagngatgacttacgaaagtacctnatttgatttcngactaancgactaacngaaaaccgnggacacgggcagtgtattatgtgttgtgtttaantcaaggtactgtaccg

SEQ ID NO: 438916 - DNA, 805 bp, Homo sapiens
  misc_feature: GZ8MTXP02FRRTU.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtctgggttttccttgttgttattttacaaggtgtcagagtgaagtgcaggttggtgggaggtccgggggagacgttggtccagccgtgggacgggtccctgagactctcctgtgtcgctctggatcacatcagtcgaccactatatggacgtgggtcccgccgaggccgtaccggaggggaacggggctggggaggtcgggtcgttcggggaccgtaacgaaaacggttaaaaaaaccgtaacggtttacggaccctaaggttacctttttacgaccaacggaaggtaaccggttaaccgggcccgtacgttcgtacggtaagaaaccgtcccgaaaggtacctttacccaccccttacctaacgaaacggtagtaacgtacggtaaaccttaccggaaaacgttaaaccgttactaattttcggtaactttacccgtagggtaactaaacggttaaaccgtaaacccgtttaaaacccgtaaaacgggtaaaaacccccggggtaaagggtaaaccggaaacccgggggtaacttaaaggtttacggtttaaaacgtttttaacggttgggttttacggtttaaggttttacgttttaaaagttacgtaaccggttaaaagggtaaccccgtttaggttaacccccggg

SEQ ID NO: 438917 - DNA, 623 bp, Homo sapiens
  misc_feature: GZ8MTXP02JBPJI.44.36.D03.1.454.CMB.2.raw
  modified_base (310)..(310): a, c, t, g, unknown or other
  modified_base (375)..(375): a, c, t, g, unknown or other
  modified_base (516)..(516): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtcgaccactatagtggactgggtcccnccaggctccgaggggagggctggagtggctggccgacaagtaaaaacaagttgcctagtctttancacgagacgtacgccgcgtctgtagaaacgcccaagacttccaaccctctacaagagatcgaacttacgaaagtaccttcgtaattggaactttcgagaccgtaaatcggaaaccttaaacccgtaaggaaaaaccccggngggaaacccaccgggggtacaaagttacggtttaactttacgtttggttacgttttaaggttagtttttaaatacgttacggaaaggtaccttacggttaaccccgg

SEQ ID NO: 438918 - DNA, 630 bp, Homo sapiens
  misc_feature: GZ8MTXP02HC8VS.44.36.D03.1.454.CMB.2.raw
  modified_base (306)..(306): a, c, t, g, unknown or other
  modified_base (381)..(381): a, c, t, g, unknown or other
  modified_base (590)..(590): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtgggagggtccctgagactctcctgtgtcgctctggattcaccatcagtgaccactatagtggactgggtcccncgaggctccgaggggaaggggctaggagtgggcttgggccgacgaaagtaaaaacgaagtcgaccagtctttaancaaccagcgtaccgcctacggtctaggtagaaacccccgcaagtacttacccaccccgtatacgaaagtacgatacggaacttacgaaaagacttacaatttcgaatttcgaggacgtaaaatcgtaaaacctaaacgtaacggaaaaaccggcggaaacgaccggggataagttggttaatttaatggttagtttcgtagttttaaanagtaacgaaggtactcgacgtacggtacgggaccgacggg

SEQ ID NO: 438919 - DNA, 769 bp, Homo sapiens
  misc_feature: GZ8MTXP02GV11K.44.36.D03.1.454.CMB.2.raw
  modified_base (293)..(293): a, c, t, g, unknown or other
  modified_base (328)..(328): a, c, t, g, unknown or other
  modified_base (429)..(429): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttggtccaggccgtgggacgggtccctggacgtactctcctgtcgtccgcctctggacttccacntcagtcaaccactatagtcggacgtcggggtcccncgaggcctaccggaaggggaacggggctagggaggtgggtcgttcggggaccgaacgtaaaacggtaaaaaactaaacggttcgaccctaagttactttanccaaacgtaagtaacgtacccggcccgtcgttacctaggtaacggaaaacgccccgaaagttacctttacccaacccccttgaaccaaagggtaacacttacggtaaacctttacgaaaaacgtaccctttataagtttaagtctttaccgacggtaaagtaaacgtaccggtaaaaccttaaaacccggaaaacggggaaaaaacccccggtaggggaaaacccggtaaccgggggtacttaaaggttagggtttaaaactttttagtgggttttaggtttaaggttttaagtttaaaccttagtaacggtaacggttaaacccttcggtaaacccggg

SEQ ID NO: 438920 - DNA, 707 bp, Homo sapiens
  misc_feature: GZ8MTXP02HCBCX.44.36.D03.1.454.CMB.2.raw
  modified_base (225)..(225): a, c, t, g, unknown or other
  modified_base (317)..(317): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtgggaggtccggggganacgttggtccagccgtgggacgggtcctgagactctcctgtgtcgcctctggattcaccatcagtcgaccatatagtggacgtcggggtccnccgaggcctccggaggggacggggctgggaggtcggcgttcgggaccgacgtaaaagtaaaaacgtaaggttcgaccgtaagtacttttagaccaacgaaggtacgtaacccggtcccggacggttactagggtaacggaaaaacccggtcccaaaaggttaccctttaccccgtaacccccttacgtaaccgaaaaggggtactaactacggtaaaccctttacgaaaaacgtaccttacgtaatttacggtaactttcgaggaaccgtaattacgaaacccttaaaccgaaggaaaaacccggaggaccgacgggactaattggttaatttgttggtttagtttaacgtttagttttaacacgtacggtaacggttacctcggtaccg

SEQ ID NO: 438921 - DNA, 587 bp, Homo sapiens
  misc_feature: GZ8MTXP02GNDO9.44.36.D03.1.454.CMB.2.raw
  modified_base (225)..(225): a, c, t, g, unknown or other
  modified_base (315)..(315): a, c, t, g, unknown or other
  modified_base (396)..(396): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacttggtccagcctgggagggtccctgagactctcctgtcgtcgcctctggacttcaccatcagtcgaccactatatggacgtgggtccnccgaggcctccgaggggaggggctggggagtgggcgttcgggccgacgaaagtaaaaaacaaggttcgacctagtctttancaacgagacgtaccgcgcgtctgtagaaacgcagtacttcccaccctctacaaganatcgacttacaaagtactcattgattcgagacgtaagtacgaactaaccgtaaacgaaaaccggaggaaccgacgggactagttagttattagttggttgttgtacgtttagtactacgacgtacgttcgtaccg

SEQ ID NO: 438922 - DNA, 576 bp, Homo sapiens
  misc_feature: GZ8MTXP02FYZUI.44.36.D03.1.454.CMB.2.raw
  modified_base (267)..(267): a, c, t, g, unknown or other
  modified_base (306)..(306): a, c, t, g, unknown or other
  modified_base (343)..(343): a, c, t, g, unknown or other
  modified_base (371)..(371): a, c, t, g, unknown or other
  modified_base (377)..(377): a, c, t, g, unknown or other
  modified_base (409)..(409): a, c, t, g, unknown or other
  modified_base (414)..(414): a, c, t, g, unknown or other
  modified_base (425)..(425): a, c, t, g, unknown or other
  modified_base (441)..(441): a, c, t, g, unknown or other
  modified_base (485)..(485): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtgggagggtccctgagactctcctgtcgtcgcctntggattcaccatcagtgaccatatatggactgggtcccncaggctccgaggggagggctggagtggcttggccganaagtaaaaacaagttcaccagtctttancagagngcgcgtgtctgagaacgcagtctccacctcanaaganatacgtactanaaacgtactatagttnacttcgagacgtaatacgaaacctaaaccgaacggaaaaccggngaaccgacggactagtagttatttagttgttagtttagttagtttactatcgtaaggtactcggtaccgtacggtacggggacctaacggg

SEQ ID NO: 438923 - DNA, 593 bp, Homo sapiens
  misc_feature: GZ8MTXP02F1D6R.44.36.D03.1.454.CMB.2.raw
  modified_base (321)..(321): a, c, t, g, unknown or other
  modified_base (395)..(395): a, c, t, g, unknown or other
  modified_base (398)..(398): a, c, t, g, unknown or other
  modified_base (411)..(411): a, c, t, g, unknown or other
  modified_base (444)..(444): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagagactcaccatggagttcgggctgagcttgggttttccttgttgttattttacaggtgtccagagtgaagtgcaggttggtggaggtccgggggagacgttggtccagccgtggacgggtccctgagactctccgtgtcgtcgcctctggattccaccatcagtcgaccaactatagtggacgtcgggtcccncgaggctaccggaggggaggggcgtgggagtggcgtggccgacgaaagtaaaaacaaggttcaccagtctttancanagacgtcgcgctntgtagaaacgcagacttcccacctctacaaganatgtaacttacaaagtacctatattgtacttcgcgtacaagttacgaaacctaaccgtaaacggaaaaccgacgggaccacggggactaagttagttactttaagttgtttgttaagtttagtttatacgtcgaaggtacttcgtaccg

SEQ ID NO: 438924 - DNA, 856 bp, Homo sapiens
  misc_feature: GZ8MTXP02IUCOA.44.36.D03.1.454.CMB.2.raw
  modified_base (407)..(407): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggtggaggtccgggggagacgttggtccagccgtgggacgggtccctgagactctcctgtgtcgcctcgtggacttcaccatcagtcgaccactatagtggacgtcgggtcccgccgaggcctaccggaggggaaggggcgtagggaggtgggtccgttgggccgacgaaagtaaaaaacgaaggttcgaccagtctttancaacgagaacgtaccgccggtcgttctaggtacgaaaacgcccaaggtacttcccaacccccgttctaacgaaaggacgtaacttcggtaaacctttaaccgaaaaggttaaaccctttcgtaaagttttacgggtaacttttacccgtaaggtaaacccggttaaaacgttaaccgggtaaaaacccccttttaaaaaacccccgggttaaaacccgggggaaaaaaaaaaacccccggggtacgggggtaaaaaccccggaaaacccccggggggtacttaaaaacgggtttttaacggttttaaaacgtttttttaaaacgggtttttcggggttttaaagggttttttaagggttttaaacggtttttttaaaacgttaaaccggttaacccgggtaaaaacgggggtttaaaaccccctttgggggtttaaaaccccccccggg

SEQ ID NO: 438925 - DNA, 624 bp, Homo sapiens
  misc_feature: GZ8MTXP02FMKFP.44.36.D03.1.454.CMB.2.raw
  modified_base (311)..(311): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctatttagaaggtgtccactgtgaggtgcggctgggtggagtcgtgggggaggcttgggtacgaggcgggggggtccctggagactctcctgtgcagcctctggattcattcttcagtgactatgccatgaactgggtccncgaggctaccgaggggagggctggaggtggttccattatgttaatattgcgttggaagactaccacctactacgcaagacctcgtagtaggaaacgggcccgtaattacgaaccctaaattccccggaaggggaaacaaagtcggacccaaaaggtacctacaccttaggtaatccgtaagggaaaacttgaaaacaggtacctaggaaacgaaggaaccggaaaggaaccgaacggggtcttacggttacccttaacgtttccgtaaggtttcgaaaggacggtacgtacccggggcctaacgttttcgggg

SEQ ID NO: 438926 - DNA, 716 bp, Homo sapiens
  misc_feature: GZ8MTXP02H8IUC.44.36.D03.1.454.CMB.2.raw
  modified_base (412)..(412): a, c, t, g, unknown or other
tcagacagtatatacacgaccggtgctcgatttagctgcgtcacgatctctcttgggggagctctgagagcggagcccagccccagaattcccaggtgttttcatttggtgatcagcactgaacacagaggactcaccatggagttcgggctgagcttgggttttccttgtttgttattttacaaggtgtccagagtgaagtgcgagttgggtgggaggtccgggggagtacgttggtccaggccgtgggacgggtccctggagactctcctgtgtcgcctctggacttcaccatcagtcgaccactatagtggacgtcgggtccgaccagggcctaccggaaggggaaggggcgtagggagtggtcgtcgggccgagaaaacgtaaaaacaagtcgacctaggtctttacncgtaaacacggtacgtacccgccgtacgttactagggtaagaaaaccggtccctaaagtaccttacccgtaacccctactaaccaaaggtacgtattacggtaaaccctttaacgaaaacgtaaacctttctaagttacgtaactttcggaaggtaacgtaaactaacgtaaacccgtaaaaccggtaaacggaaaaacccggtaggaaacccgtacgggtactaaaggttagtttaaacgtttagtttcggttagtttaaggtttattaaagtacgttacggtaacggtaacgttcggtaccg

SEQ ID NO: 438927 - DNA, 577 bp, Homo sapiens
  misc_feature: GZ8MTXP02JNT09.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctatttagaggtgtccactgtgaggtgcggctgggtggagtcgtgggggagcttgggtacgagggcgggggggtccctggagactctcctgtgcagcctctggattcatcttcagtgactatgccatgaacgtgggtccgcaggcctccggaggggaaggggctagggaggttgggttaccagttagttgttaatagttgcgtgggacactaccacctatacgcagactcgtggtagaacgggtccaagttccaaccaattcccgaagggtacaagtcgacccaaagacctcactagtatcgtaaggaaatagaaacagcctagaacgaggacggaaggtacgacgggtacttcgaccttacgttcgtaagttacggaagtacgaggtcccggtactacgtttcggg

SEQ ID NO: 438928 - DNA, 676 bp, Homo sapiens
  misc_feature: GZ8MTXP02JP26Q.44.36.D03.1.454.CMB.2.raw
  modified_base (323)..(323): a, c, t, g, unknown or other
  modified_base (407)..(407): a, c, t, g, unknown or other
  modified_base (648)..(648): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccaggcccgtgggacgggttccctggacgacttccgtcctgtgtcgcctcgtggattcaccatcagtcgaccactatatggactgggtccnccaggcctccgaggggaaggggtcgtgggaggtggcttcgggaccgacgaaagtaaaaaaccaaggttcgaccgagtcttttanccgaacgagtaacgtaccgcccggtcgtcgtagtacgaaaacggccctaaggtacctttacccgaaccccgttacgtaccgaaaaggtacgtagttacgtaaacctttacaaaacgtacctttacgtaatttcggtaatttccgagtacgtaaatacggaaccttaaaccgtaacgaaaacccggtggaaccggacgggactagttgttaattacgtttggttagtttgttacgttttaanacgttacgtaggttaactcggtaacccg

SEQ ID NO: 438929 - DNA, 570 bp, Homo sapiens
  misc_feature: GZ8MTXP02H1WIH.44.36.D03.1.454.CMB.2.raw
  modified_base (262)..(262): a, c, t, g, unknown or other
  modified_base (270)..(271): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (348)..(348): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggtttcgtgtagtattacaagtgtcagagtgaagtgcagtggtggagtcgggagagtggtcagctggagggtccgtgagactctcctgtgtcgcctctggattnaccatcannacactatatgacgtcggcgcgagcgcgaggagggngngngtgtgtgcgacaagtaaaagaaagtagacgagtacttntacacgagagtacgcgcgtctgtagaacgacgacgactacctacctactacgaagagagtacgtactactaaacgtaactactattagtattacgtacgtacgtaagtaacgtaaactaaaccgtaaacgaaaacgaaacggaacgacggacgtacgtacgttaacgttaagttagttagttaagtttagtttaattacgtacgtaacgtaacgtacgtacg

SEQ ID NO: 438930 - DNA, 669 bp, Homo sapiens
  misc_feature: GZ8MTXP02GM03S.44.36.D03.1.454.CMB.2.raw
  modified_base (209)..(209): a, c, t, g, unknown or other
  modified_base (400)..(400): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggaggtccgggggagacttgggtccagccgtgggacgggtccctgacgctctcctgtgtcgcctctggacttcaccatcagtcgaccactatagtggactcggggtcccgccgaggcctaccggaggggaacggggctggggagtggcgttgggccgacgaaagtaaaaaccaagttgacccagtctttancacagacgtacgccgtgtctagtagaaacgcccaagtacttcccaccctctacaaagcgtatacgtaacccttagaaaacgtaaccttcgaatttacggtactttcgacggtaccgtaaaagttacggtaaacccttaaacccgtaaacggaaaaacccggacggggtaacccgaacgggggtactaagttagtttaactttaggtttaggtttggtttaaggtttagtttaagttacttaccggaaagggttaccttcggtaacccgg

SEQ ID NO: 438931 - DNA, 683 bp, Homo sapiens
  misc_feature: GZ8MTXP02JBTIS.44.36.D03.1.454.CMB.2.raw
  modified_base (516)..(516): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgtttattttacgaaggtgtccagagtgaagtgcaggttggtgggaggtccgggggagtacgttgggtccaggccgtgggacgggtccctggagactctccgtgtcgtcgcctcgtggacttccaccatcagtcgacccatatagtggacgtcgggtcccgccgaggcctccggaaggggaaggggctaggggaggtcggtcgtcgggaccgacgtaaaagtaaaaacgaagttcgacctagtctttagcaacgagacgtaccgccgtgtctagtacgaaacgcccaagtacttcccacccttcaacgaaagagtactacgtaaccttacgaaaagtaccttntaagtttacgtaatttccgacgtaacgttaaaatacggtaaaacccttaaaccggaaaacggaaaaacccggcggaaaccgtaaccggggactaagtttagttacgtttaagtttggttacgtttaagttagtttaacacgttacgaaggttacctacggtacccgg

SEQ ID NO: 438932 - DNA, 672 bp, Homo sapiens
  misc_feature: GZ8MTXP02HM778.44.36.D03.1.454.CMB.2.raw
  modified_base (308)..(308): a, c, t, g, unknown or other
  modified_base (382)..(382): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacgttggtccagcctggagggtccctgagctctcctgtgtcgcctctggattcaccatcagtgaccactatatggactgggtccnccgaggctccgaggggaggggctgggagtggcgttggccgacaaacgtaaaaacaagttcgacctagtctttanctacaagacgtacgcccgtagtcctgtagaaaacgccaagtactttcccaccccttacgtacaaaggtacgtatacgtacctttaccgaaagtaaaccttctaaagtttcgaactttccgtaagggtaccaaaagttacggaaaaccttaaaccccggttaaaggaaaaaaacccccgggtaggaaacccggaaccgggggtactaaaggttacggtttaattagttttacggtggttttaagttacggtttaattacgtacggtaacggtaaacgtttcgggtaacccg

SEQ ID NO: 438933 - DNA, 580 bp, Homo sapiens
  misc_feature: GZ8MTXP02HF9OM.44.36.D03.1.454.CMB.2.raw
  modified_base (313)..(313): a, c, t, g, unknown or other
  modified_base (320)..(320): a, c, t, g, unknown or other
  modified_base (344)..(344): a, c, t, g, unknown or other
  modified_base (381)..(381): a, c, t, g, unknown or other
  modified_base (459)..(459): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagctagtttaaccatctacaagacacctacaaaggcaggtgtcttagtanagaccanatcggacctgcggacaccgagcanatatactgtgacgtagggtaatggacgggaaagaacngtcgttggttctagtaattataacgtcttaccattctggtacgtgtagggacaaagggcctacggtcaccgtctcctnacgtcctacgaccgacgggtacccacgttccggtacccttccccggtcggcccgtccccgtacgccctccggacggaacgcccgtaccgtcggggtacggggccaacggcgtccccggggg

SEQ ID NO: 438934 - DNA, 627 bp, Homo sapiens
  misc_feature: GZ8MTXP02F2N4C.44.36.D03.1.454.CMB.2.raw
  modified_base (224)..(224): a, c, t, g, unknown or other
  modified_base (282)..(282): a, c, t, g, unknown or other
  modified_base (323)..(323): a, c, t, g, unknown or other
  modified_base (396)..(396): a, c, t, g, unknown or other
  modified_base (450)..(450): a, c, t, g, unknown or other
  modified_base (461)..(461): a, c, t, g, unknown or other
  modified_base (487)..(487): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccggggganacgtttgggtccaggcccgtgggacgggttccctggagactctcctgtgtccgcctcnggattcaccatcagtgacccactatagtggactgggtcccnccgaggcctccgaaggggagggctggggagtggcttggccgaccaaagtaaaaccaagttcgacagtctttancacgagacgtaccgcgcgtctgtagaaacgcccaagtactttccgaaccccttntacaaaggtanagtacgtaaccttaacaaacgtactntaagtttgattcgagacgtaatacgaaacctaaacgtaacggaaaaccggaggaccgacggtactaagttagtttaagtttagtttggttagtttaacgtttagttttaactacgtacgtaaggttaacgtccgtaaccg

SEQ ID NO: 438935 - DNA, 677 bp, Homo sapiens
  misc_feature: GZ8MTXP02F8WQ1.44.36.D03.1.454.CMB.2.raw
  modified_base (394)..(394): a, c, t, g, unknown or other
  modified_base (459)..(459): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttgggtggaggtccgggggagacgttggtccagccctgggacgggtccctgagactctcctgtgtcgcctctggattccaccatcagtcgaccactatagtggacgtcgggtcccgccgaggcctccggaggggaaggggctgggagtggcttgggccgacaagtaaaaacaagttcgaccagtctttancaacagacgtaccgccgtcgtctgtagaaacgcccaagtacttcccgaaccccttctacaaaggngtatcgtaaaccttacgaaaacgtaaccttctaagtttacggatttaccgtaggaccgtaaagttacggtaaacccttaaaacccgtaacgggaaaaaaccccggtacgggaaaacccgaccgggggtactaagtttaacggtttaactttagtttggtttaggtttgtttaacgttttaatacgtaccgtaaaggggtaacctttcggtaaccccgg

SEQ ID NO: 438936 - DNA, 715 bp, Homo sapiens
  misc_feature: GZ8MTXP02F7EVE.44.36.D03.1.454.CMB.2.raw
  modified_base (344)..(344): a, c, t, g, unknown or other
  modified_base (371)..(371): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtgggacgggtccctgagactctcctgtgtcgcctctggattcaccatcagtgaccatatatggactgggtccgcaggcctccgaggggagggctgggagtggcttgggccanaagtaaaacaagttcgaccagtcttancacagagtacgccgtcgtcgtgtagaaaacgcccaagtactttacccacccccttacgtacgaaaggtacgattacggtaacctttaccgaaaagtaaccttacaaattttacggaacttttccgtaggtaaccgttaaaagttaccggtaaaccttaaaaccccggttacgggaaaaaaacccccgggtaggggaaacccgaaacgggggtacctaaaggtttaggttaaagttttaagtttaggttaggtttttagttaacggtttttaattaagtaaccgtaaaggggtaaaccttcggggtaccctaacgggttacgggggaccccgtaaaacccggggg

SEQ ID NO: 438937 - DNA, 564 bp, Homo sapiens
  misc_feature: GZ8MTXP02H8B2S.44.36.D03.1.454.CMB.2.raw
  modified_base (199)..(199): a, c, t, g, unknown or other
  modified_base (207)..(207): a, c, t, g, unknown or other
  modified_base (291)..(291): a, c, t, g, unknown or other
  modified_base (300)..(300): a, c, t, g, unknown or other
  modified_base (357)..(357): a, c, t, g, unknown or other
  modified_base (360)..(360): a, c, t, g, unknown or other
  modified_base (373)..(373): a, c, t, g, unknown or other
  modified_base (398)..(398): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagatgaagtncagttggnggagtccgggggagacttggtcagcctggagggtccctgagactctcctgtgcgcctctggattcaccatcagtgaccatatangactggccnccaggctcgagggagggctggagtggctggcaccaagtaaaaacagtgcagctttancanagacgtacgcgtntcagagaaacgcagtactccacctnacaagagatagtaaccttagaaactaacttactattagtattacgagaacgtaagtacgtaaaacctaaaccgtaaacggaaaaaccgaggaccgtacggactaagttacgttaactttagttgttagttgtttactttaatacgtacgaaggtaccttcggaccg

SEQ ID NO: 438938 - DNA, 705 bp, Homo sapiens
  misc_feature: GZ8MTXP02HHYLL.44.36.D03.1.454.CMB.2.raw
  modified_base (217)..(217): a, c, t, g, unknown or other
  modified_base (340)..(340): a, c, t, g, unknown or other
  modified_base (367)..(367): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagctctcctgtgtcgctctggattcaccatcagtgaccactatatggactgggtccgcaggctccgaggggaaggggctggaggtggcttggccganaagtaaaacaagtcgaccagtctttancacagacgtacgcgcgtctgtagaaacgccaagtacttacccaaccctctaccaaagagtatacgaactttaccggaaaataccttaccaaattttcggaaactttttccgaggaccggtaaaattccggaaaacctttaaacccgtaaacgggaaaaaaccccggaggggaaacccacgggggacctaaaggtttacgggttaaacttttaaacggtttgggttacgtttttacgggttaacggttttttaactaaagtttccgtaaaagggggttaaacctttcggtttaaccccgacggggtttaaccggggggtacccctaaaacccggggggg

SEQ ID NO: 438939 - DNA, 595 bp, Homo sapiens
  misc_feature: GZ8MTXP02JNS8Y.44.36.D03.1.454.CMB.2.raw
  modified_base (363)..(363): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgctgggttttcctgttgctatttagaaggtgtccactgtgaggtgcggctggtggagtcgtgggggagcgttggtacgagggccgggggggtccctggagactctcctgtgcagcctctggattcatcttcagtgactatgccatgaacgtggtcccgcaggctccgaggggaagggctggagtggttaccagtatgttaatgttgctgganataccgacctatacgcagtactgttcggagaacgggcctattaccaacctaagttcccgaagggacctaagtaccgaacccaaagtaccttccaagttggtaaacttcgtaaaggaaaattcggaaacacgaccgtagaacggaagaacggacgaaccgacggtacttcgtacctttaacgtcgttaacgttaccggaagtaacggacgttcccgggaccttacggtttcgg

SEQ ID NO: 438940 - DNA, 659 bp, Homo sapiens
  misc_feature: GZ8MTXP02F8VCI.44.36.D03.1.454.CMB.2.raw
  modified_base (311)..(311): a, c, t, g, unknown or other
  modified_base (396)..(396): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtcagagtgaagtgcaggttggtggaggtccgggggagacgttggtccaggcctggagggtccctgagactctcctgtgtcgcctctggattcacatcagtgaccatatagtggacgtgggtccnccgaggctccggaggggaaggggtctaggggagtgggcgttggaccgaccaaagtaaaaaaccaaggttcgacctaagtctttancacgaagacgtaccgccgtcgtctagtagaaacgccagtacttcccaccctctacaaagcgtaatcgtaaacttacgaaaagtaaccttctaagtttagactttacgaggtaaccgtaaattacggaaacccttaaaacccggtaaacggaaaaacccgggacggaaaccggacggggaaaccttaagttacggttaacttttagttggtttagttaagtttagtttaatacgttacgtaacgggtaaccttcggtaacccgg

SEQ ID NO: 438941 - DNA, 565 bp, Homo sapiens
  misc_feature: GZ8MTXP02GKVAV.44.36.D03.1.454.CMB.2.raw
  modified_base (273)..(273): a, c, t, g, unknown or other
  modified_base (311)..(311): a, c, t, g, unknown or other
  modified_base (372)..(372): a, c, t, g, unknown or other
  modified_base (388)..(388): a, c, t, g, unknown or other
  modified_base (400)..(400): a, c, t, g, unknown or other
  modified_base (420)..(420): a, c, t, g, unknown or other
  modified_base (428)..(428): a, c, t, g, unknown or other
  modified_base (450)..(450): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtgggagtccgggggagacttggtccagcctggagggtccctgagctctcctgtgtcgcctctggnttcaccatccagtcgaccactatatggactggggtccncaggctccgagggagggctgggagtggctggccgacaagtaaaaacaagttgccagctttncaacagagtaccgcgngtctgtagaaancccaagtacttcccaccctntacaaagngatgaacttacaaagtaacctntattgattcgagacgtaatacgaacctaacgaacgaaaaccgaggaccgacggctaattagttaattacgttggttgttaagttactttaatacgtacgaaggtaactcgtaccg

SEQ ID NO: 438942 - DNA, 623 bp, Homo sapiens
  misc_feature: GZ8MTXP02GJL88.44.36.D03.1.454.CMB.2.raw
  modified_base (315)..(315): a, c, t, g, unknown or other
  modified_base (370)..(370): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgcttattttagaaggtgtccactgtgaggtgcggctggtggagtcgtgggggaggcgttgggtacgagggcgggggggtccctggagactctcctgtgcagcctttggattcatcttcagtgactatgccatgaacgtgggtcccncgaggctccgaggggaggggctggaggtggtttcagtatgttaatattgctgggngactaacccacctactacgcagactcgtagtaggacggctattacccaactaacgttccgaagggaccaagtcgaacccgaaagaaccttcgtaaccgtgttaacgttacgtaaggtaaaatcggaaaaccacggccttaggaaaggaaccggaacggaacggaacgaccgggtacttacggttaccttaccgtttccgtaggttaaccgaggtaaacggtcggtacccggggtacctaacggttttggaccg

SEQ ID NO: 438943 - DNA, 652 bp, Homo sapiens
  misc_feature: GZ8MTXP02I72WI.44.36.D03.1.454.CMB.2.raw
  modified_base (403)..(403): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagtacgttggtccagccgtgggacgggtccctgagactctcctgtgtcgcctctggattcaccatcagtcgaccactatagtcggacgtcggggtcccgccgaggcctaccggaggggaacggggctgggaggtggcgttggccgacgtaaagtaaaaacaagttcgacctagtctttancaacgagacgtaccgccgcgtctgtagaaacgcccaagtacttcccacccttctaacgaaagagatacgtaaccttacaaacgtaacttctaagtttgtaaactttcgagtaaccgtaaagttacggtaaacccttaaaccgaacggtaaaaaacccggcgggaaaccgacggggaactaagttacgttatttaagtttggttagtttgtttagtttactagttaccgtaaggtaacctttcggtaccg

SEQ ID NO: 438944 - DNA, 591 bp, Homo sapiens
  misc_feature: GZ8MTXP02HP98W.44.36.D03.1.454.CMB.2.raw
  modified_base (270)..(270): a, c, t, g, unknown or other
  modified_base (304)..(304): a, c, t, g, unknown or other
  modified_base (382)..(382): a, c, t, g, unknown or other
  modified_base (423)..(423): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttgggtccagccgtgggaggtccctgagactctcctgtgtcgcctctggntcaccatcagtgaccactatatggactgggtccnccaggctccgaggggaagggctgggagtgggcgttggccgacaaagtaaaaacaagttcgaccagtctttatcacagngtacgcgcgtctgtacgaaagcccaagtacttcccaccctntacaaagagatgaacttacaaagtactctaagtttgatttcgagtacgaaatcgaaaccttaaaccgagaaaacccgaggacctacgggctaagttgtatttagttggttgtttagttgtttaacattcgaaggtaactcgtaccacggtcgggggacctaaccgggg

SEQ ID NO: 438945 - DNA, 534 bp, Homo sapiens
  misc_feature: GZ8MTXP02HCVOI.44.36.D03.1.454.CMB.2.raw
  modified_base (374)..(374): a, c, t, g, unknown or other
  modified_base (390)..(390): a, c, t, g, unknown or other
  modified_base (435)..(435): a, c, t, g, unknown or other
  modified_base (443)..(443): a, c, t, g, unknown or other
  modified_base (453)..(453): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgagggaaggggctgggagtggcttggccgcaagtaaaaacaagttgaccagctttancacagacgtacgccgngtctgtgaaagccagtacttcaccctctacaaagagatgaccttnaaagactnattgatttcngtacaatgaactaaccgtagaaaacccgngacacgggcagtgtaattatgttgttgtagtttacatcaggtaactggtacc

SEQ ID NO: 438946 - DNA, 610 bp, Homo sapiens
  misc_feature: GZ8MTXP02GRKT7.44.36.D03.1.454.CMB.2.raw
  modified_base (275)..(275): a, c, t, g, unknown or other
  modified_base (316)..(316): a, c, t, g, unknown or other
  modified_base (392)..(392): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtcagagtgaagtgcaggttggtgggaggtccgggggagacgttggtccaggcctgggacgggtccctggagactctcctgtgtcgcctntggattcaccatcagtgaccatatatggactcggggtcccnccgaggcctaccggaggggaggggctgggagtggctcggggccacgaaagtaaaaacagttcgacctagtctttancaacagacgtaccgccgcgtctgtagaaagccagacttcccaccctctacaaagagactagaaccttacaaacgtaactctattaggtacttcgtgaacgtaatacggaaaccttaaaccgaacggaaaaacccgacgggaaacggacgggtactagtacgtttaacttagtttggttattggttatttaacgtatacgaacggtacttcgtacccgg

SEQ ID NO: 438947 - DNA, 588 bp, Homo sapiens
  misc_feature: GZ8MTXP02F934U.44.36.D03.1.454.CMB.2.raw
  modified_base (203)..(203): a, c, t, g, unknown or other
  modified_base (217)..(217): a, c, t, g, unknown or other
  modified_base (302)..(302): a, c, t, g, unknown or other
  modified_base (341)..(341): a, c, t, g, unknown or other
  modified_base (370)..(370): a, c, t, g, unknown or other
  modified_base (415)..(415): a, c, t, g, unknown or other
  modified_base (490)..(490): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccggggganacttggtccagcctggagggtccctgagactctcctgtgtcgcctctggattcaccatcagtgaccactatatggactgggtccnccaggctccgaggggagggctggagtggcttgggccganaagtaaaaaacagttcgaccagtctttancaacagcgtacgccgtgtctgagaaacgccagacttccaaccctntacaagagatgaacttacaaagtactacattgatttcagacgtaatacgaactaaaccgtacggaaaaaaccggngaacgacggactagttagttaatttacgttgttagtttagttagtttatacgtaacgtaacggtacttcggaccgtacggtccggggaccgtaacggg

SEQ ID NO: 438948 - DNA, 581 bp, Homo sapiens
  misc_feature: GZ8MTXP02HYZL4.44.36.D03.1.454.CMB.2.raw
  modified_base (299)..(299): a, c, t, g, unknown or other
  modified_base (380)..(380): a, c, t, g, unknown or other
  modified_base (466)..(466): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggagggtccctgagactctcctgtgtccgcctctggattcaccatcagtcgaccatatanggactgggtccgccaggctcgaggggaagggctggagtggctggccgacaaagtaaaaacaagttgcttagctttatcaanagagtaccgccgcgttctagtagaaacgccagacttccaccccttctacgaagagatagactttacaaagacttacattgattcgngacgaactgaacctaaaccgtagaaaaaccgaggaaaccgacgggactagttacgttagtttagttagttggtttaagtagttttaactagttacgtaaggtaacgttcgtaccg

SEQ ID NO: 438949 - DNA, 684 bp, Homo sapiens
  misc_feature: GZ8MTXP02IDCYC.44.36.D03.1.454.CMB.2.raw
  modified_base (271)..(271): a, c, t, g, unknown or other
  modified_base (273)..(273): a, c, t, g, unknown or other
  modified_base (278)..(278): a, c, t, g, unknown or other
  modified_base (284)..(284): a, c, t, g, unknown or other
  modified_base (303)..(303): a, c, t, g, unknown or other
  modified_base (383)..(383): a, c, t, g, unknown or other
  modified_base (387)..(387): a, c, t, g, unknown or other
  modified_base (401)..(401): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagtcgttgggttttccttgtttgttattttacaaggtgtcagagtgaagtgctagttggtggaggtccggggatacgttggtccagccgtgggacggtcctgagctctctgtgtcgctngntcacntcagtnacatatgtgacgtggtccncgacggcctacgggaagggagggcgtggagtcggtcgtggccacgaaaaacgtaaaaacgtagtcgactagttactttanacanagacgtaccgcgtntctagtagaagccaagtaccttcccaacccttacgaacaaagacgttaactacggtaaactttaaccgaaaagtaacctttacgtaatttacgtaacttccggtaaacgtagtaaacgtacgtaaaaccttaaacccggaaaaggaaaaccccggaaagggacccgaaccggggaaactttaggttaaacgtttaaacgtttgttttacggtttgggtttttaagtttaatttttaaccgtaagttacccggtaaagggtttaaaccttcggtaaacccccgg

SEQ ID NO: 438950 - DNA, 591 bp, Homo sapiens
  misc_feature: GZ8MTXP02H3VQQ.44.36.D03.1.454.CMB.2.raw
  modified_base (216)..(216): a, c, t, g, unknown or other
  modified_base (373)..(373): a, c, t, g, unknown or other
  modified_base (376)..(376): a, c, t, g, unknown or other
  modified_base (379)..(379): a, c, t, g, unknown or other
  modified_base (393)..(393): a, c, t, g, unknown or other
  modified_base (402)..(402): a, c, t, g, unknown or other
  modified_base (548)..(548): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccggggganacttggtccagcctgggagggtccctgagctctcctgtgtcgctcgtggattcaccatcagtgaccactatatggactgggtccgccagggctccgaaggggaaggggctgggagtggcttggccgacaagtaaaaacaagttcgaccagtctttancanagngtaccgcgcgtcgngtagaaacnccagtatacccaccctacacaaagagtatacgtacttaacacgaacttagaatttcgaatttccagacgtaatacgaacctaaacgtaacgaaaaccgacggaacgacggactagtaggttattattacggtgtttagtactttanagttaagacgtaactcggtacaccggtcgggaccgtaaccggg

SEQ ID NO: 438951 - DNA, 776 bp, Homo sapiens
  misc_feature: GZ8MTXP02JSZGI.44.36.D03.1.454.CMB.2.raw
  modified_base (178)..(178): a, c, t, g, unknown or other
  modified_base (199)..(199): a, c, t, g, unknown or other
  modified_base (229)..(229): a, c, t, g, unknown or other
tcagacagtatatacacgaccggtgctcgatttagctgcgtcacgatctctcttgggggtgggcacaagaggcagcactcaggacaatctccagcatggcctggtctcctctcctcctcactctcctcgctcactgcacagggtcctgggcccactctgtgctgacgcagccgccctnagtgtcgtcggggccccgggnaggagggtcaccatctcctgcacgtgggancagactccaacagtcgggacagtattctgatcgtccacgtacggtaacccaactacccttaccgaacggtaaaccaccgaccccccctaaaactccctactaactttaccgttttacggtaaaacctaacgttacgtcccgggacccctacggtaaccggggttccccccctacggaacccgtatttcccgtaccgtcggtaccctacccgtaacgttccgtacgggtacccacccgttaccgaccggtcccccttcccgttccggaccctaacgtacccgtacggttcccggggtaccctaccccggagggtacccgttaggaaaacggtgttacggggaggggttaatttaacgtttaacgttaaccgtcgtacccgttaacggttaccctaagttacggaacgtacggccgtaacgcccgttaacggtacgggtttgggggttcggggttacgggttccggggacggggtaaccgggtaccgaaaccggtcggtacccggtaccgggtccggtacggggtaccgaaccggtacccggaaccggg

SEQ ID NO: 438952 - DNA, 692 bp, Homo sapiens
  misc_feature: GZ8MTXP02HI445.44.36.D03.1.454.CMB.2.raw
  modified_base (202)..(202): a, c, t, g, unknown or other
  modified_base (362)..(362): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccacctcaacgtctcgggaccccggnagagggtcatcatctcttgttctggaagcagttccaacatccggccctaattctgtattattggtaccagcaacgtccccaaggaaccggcccccaaactccctacactctataggaactaaatcacgccggccctcgacggggtccctgaccgatttcnccgtcggcctacaagtctcggccacctcacgtccctcccgtggtcccattcgacggttccgggcccccggtacgacgggacgtagggttgaacttactacgtgccgtcagtccgttgggacttcggacccgtccgtggacggggtcttcggggccgttaggttccgggacggggtaaacgggaaccccgtaaaacgttccgggtaaccccggttaccggttaaacgggtccgaacgggacccccgaaacgggtccgtccccggtacccccccgttcgggttaaaccccctacccgtttcccggtttaccccgtttacccccctaaccccg

SEQ ID NO: 438953 - DNA, 615 bp, Homo sapiens
  misc_feature: GZ8MTXP02JE1S2.44.36.D03.1.454.CMB.2.raw
  modified_base (356)..(356): a, c, t, g, unknown or other
  modified_base (365)..(365): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggaggcttggtacgaggcgggggggtccctggagactctcctgtgcagcctctggattcatcttcagtgactatgccatgaactgggtccgccaggcctccgaggggaaggggctggagttggttccatatgttaatnttgctgganactaccacctatacgcagtactctggtaggaacgggcccgatttaccaaccctaaagtttccccgaaggggaccaaagtcggacccaaagaacctcaaccttgtaaactcgttagggaaaacttcggaaaactacggacctaggaacgaacgggaccgaaaggggaccaacggggtcttaccggttaccttactttaccgttggttaccggaaaggtagtacggtaccggggtaccctaacggtttcggg

SEQ ID NO: 438954 - DNA, 597 bp, Homo sapiens
  misc_feature: GZ8MTXP02F9A64.44.36.D03.1.454.CMB.2.raw
  modified_base (310)..(310): a, c, t, g, unknown or other
  modified_base (372)..(372): a, c, t, g, unknown or other
  modified_base (419)..(419): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagcctgggagggtccctgagactctcctgtgtcgcctctggattcaccatcagtcaccactatatggactgggtccncaggctccgagggagggctggagtggcttggccgacaagtaaaaacagttgaccagctttancacagagtaccgcgcgtctagtagaaacgccagtacttccacccctntacaaagagtatcgtaacttcaaagtactcgatttaggactttcgtgacgtaatcgaaaccttaaccgtaaggaaaaacccgagggaacccacgggggacctaaagttacgttaatttaagtttggttagtttggtttacgttttaatacgtacgtaaacggtacgttcgtaacccgg

SEQ ID NO: 438955 - DNA, 760 bp, Homo sapiens
  misc_feature: GZ8MTXP02G2NTI.44.36.D03.1.454.CMB.2.raw
  modified_base (718)..(718): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaggtgtccagagtgaagtgcaggttggtggaggtccgggggagtacgttgggtccaggcccgtgggacggggtcccctggacgaccttcctccgtggtcgtccgccttcgtggtacttccaacccatcgagtcgaaccctactaagtagtcggacgttcggggtccccgccgaacggcctacccggaaggggggaacggggtcgtaggggtacggtcgggtccgttcggggcccgtaacgtaaaacggttaaaaaaaccgtaaggtttcgaccccgtaaggttacctttttacgccaacgtaacggtacggtaccccggcccggtacgttccgtaggtaacggaaaaccgtcccgaaggtacctttccccgaacccccttcgtaacgaaacggtagattacggtaaaccttacgaaaacgtaccttactagtttacggtaatttccgtagacgttaaatacgtaaaccctttaaaccgaaacggaaaacccgagggaacccgacgggactaagttcgttacttagttgtttaggttntttagtttaactagtacgtaacggtaaccgttcgtaacccgg

SEQ ID NO: 438956 - DNA, 663 bp, Homo sapiens
  misc_feature: GZ8MTXP02F54QZ.44.36.D03.1.454.CMB.2.raw
  modified_base (398)..(398): a, c, t, g, unknown or other
  modified_base (432)..(432): a, c, t, g, unknown or other
  modified_base (458)..(458): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccgggggagacttggtccaggccgtggacggtccctgacgctctcctgtcgtcgcctcgtggtactcaccatcagtcgaccactatagtggacgtcgggtcccgcgaggcctaccggaggggaacggggctggggagtggcttcgggccacgaaaagtaaaaacaagttcgacctagtctttanccaactaggacgtaccgccgtgtctagacgaaancccaagtacttcccacccttcgaaanaaaggtactagtacgtaaaccttaacgaaaacgttaactatagttacgtaactttcgagaacgtaaacgtacgtaaaccctaaaaccggaaacgaaaaaccgggacggaaccgaaacgggtacttaaaggtttacgtttaacgtttacgttggtttacgtttaagtttagttaacctagtacgtaacggtaccttcggtaacccg

SEQ ID NO: 438957 - DNA, 615 bp, Homo sapiens
  misc_feature: GZ8MTXP02IK53G.44.36.D03.1.454.CMB.2.raw
  modified_base (223)..(223): a, c, t, g, unknown or other
  modified_base (309)..(309): a, c, t, g, unknown or other
  modified_base (376)..(376): a, c, t, g, unknown or other
  modified_base (530)..(530): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtcgaccactatatggactgggtccncgaggctcgagggaagggctggagtggcttggccacaagtaaaaaccaagttcgacctagtctttancaacagacgtaccgccgacgttcgtagtagaaaacgtcccaagtactttcccaacccttctacaaaggacgtatcgaaacctttcaaaagtaaccttcaatttcgaacttcgtaggacgtaaatcgaaaccttaaaaccgtagaaaaacccggnggaacaaccggggctaaagttaggttaactttaagtttggttagtttgtagttttaactagtacgaggtaaaccttgttaacccg

SEQ ID NO: 438958 - DNA, 561 bp, Homo sapiens
  misc_feature: GZ8MTXP02HM45P.44.36.D03.1.454.CMB.2.raw
  modified_base (384)..(384): a, c, t, g, unknown or other
  modified_base (429)..(429): a, c, t, g, unknown or other
  modified_base (493)..(493): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacgttgggtccagcctgggagggtccctgagactctcctgtgtcgcctctggatcaccatcagtgaccactatagtggacgtgggtcccgcgaggctccgaggggaaggggctggagtggcttggccgacgaagtaaaaacagttcgacctagctttancaacagagtaccgcgtcgtctgtagaaagcccagcttccaccctntacaagagatgacttacaaagtaacctgatgattcgagacaatgaacctaacgtagaaaaccgngacgacggacagttacgtatttacgttggttagttgttagtttaatatacgaggtaacttcgtaaccg

SEQ ID NO: 438959 - DNA, 697 bp, Homo sapiens
  misc_feature: GZ8MTXP02FFJLY.44.36.D03.1.454.CMB.2.raw
  modified_base (222)..(222): a, c, t, g, unknown or other
  modified_base (307)..(307): a, c, t, g, unknown or other
  modified_base (373)..(373): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggaggtccctgagactctcctgtgtcgcctctggattcaccatcagtgaccactatatggactgggtcccncaggctccgaggggagggctgggagtggcttgggccacgaagtaaaaacaagttgaccagctttancaacgagacgtacgcgtcgtctagtagaaacgccaagtacttacccaccctactacgaaaggagtaacgttacgtaaacctttaacgaaaacgttaaccttacgtaaacgtttacggtaactttccgtaaggtaaccgttaaaagttaccggaaaacccgttaaaacccgtaaaacgggaaaaaaaccccgggaacggggtaaaacccggaaaccgggggtaactaaacgtttaacggtttaacgttttaacgttacggtttaggtttaacggtttaagttttaaacgtacgttacggtaaacggtaaaccgttcggtaacccg

SEQ ID NO: 438960 - DNA, 618 bp, Homo sapiens
  misc_feature: GZ8MTXP02GHHXZ.44.36.D03.1.454.CMB.2.raw
  modified_base (376)..(376): a, c, t, g, unknown or other
  modified_base (380)..(380): a, c, t, g, unknown or other
  modified_base (420)..(420): a, c, t, g, unknown or other
  modified_base (459)..(459): a, c, t, g, unknown or other
  modified_base (553)..(553): a, c, t, g, unknown or other
tcagacagtatatacacgaccggtgctcgatttagctgcgtcacgatctctcttgggggagagcggaaccccagccccagaattcccaggtgttttcatttggtgatcagcactgaacacagaggactcaccatggagttcgggctgagctgggttttccttgttgttattttacaaggtgtccagagtgaagtgcagttggtggaggtccggggagacttggtccagcctgggagggtccctgagactctcctgtgtcgcctctggattcaccatcagtcgaccatatatggactggggtccgccaggcctccgaggggaggggctggagtggcttggccgacgaaagtaaaaaacaaggttgcccagtctttancaanaggatccgcgcgtctgtagaaacgccagacttccaccctnacgaagagatcgacttacaaagactcaatttgatttcgngacgaaattcgaaaacctaaccgtaggaaaaacccgtggaaccgaacgggctaataggttacttttaagttcggttggtttcgttaagttttanaacgttacgaagggtaaacccttggtaccccgtagacggggggtccccaaagggggtaacccccg

SEQ ID NO: 438961 - DNA, 631 bp, Homo sapiens
  misc_feature: GZ8MTXP02HUBQV.44.36.D03.1.454.CMB.2.raw
  modified_base (313)..(313): a, c, t, g, unknown or other
  modified_base (381)..(381): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacttggtccagccgtggagggtccctgagactctcctgtgtcgcctctggattcaccatcagtgaccactatagtggactggggtcccncgaggctccgaggggaggggctaggagtggcttggccgacaagtaaaaacagttcgaccagtctttancaacagacgttacgcccgtcgtctgtacgaaacgccagtaacttcccaacccttctaacaaagcgtaaagtcgtaaactttacgaaaacgtaacttcaagtttagactttcgtgacgtaaatcggtaaccttaaaccgtaaggaaaaacccgagggaaaccctacggggactaaagttaggttaactttaagttgttaggtttgttaggttttaaacttagtacgtaaacgggttacttacggtacccgg

SEQ ID NO: 438962 - DNA, 655 bp, Homo sapiens
  misc_feature: GZ8MTXP02GYEQJ.44.36.D03.1.454.CMB.2.raw
  modified_base (282)..(282): a, c, t, g, unknown or other
  modified_base (324)..(324): a, c, t, g, unknown or other
  modified_base (492)..(492): a, c, t, g, unknown or other
  modified_base (497)..(497): a, c, t, g, unknown or other
  modified_base (508)..(508): a, c, t, g, unknown or other
  modified_base (569)..(569): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcaggttggtggaggtccgggggagacgttggtccagccgtgggacgggtccctgagctctcctgtcgtcgcctcgtggnttcaccatcagtcgaaccatatagtcggacgtcggggtcccnccgaaggccgtaccggaaggggaacggggctgggaggtcggtccgttcggggccgaaccgaaaaggtaaaaaaaccgtaaggttacgacccgtaagtacttttagcaaacgagtaacgtaccgccgtacgtctagtagaaacgcctagacttccaccctctacaaagngtacncgtaaacttanaaagtacctgaattcgtacttcctagacgtaatacgaaccttaaaccgagaaaaacccggnggaaccgaacggactagttacgtttaactttaagttggtttagttgtttagtttaactactcgtaaacggtacgttcgtaacccgg

SEQ ID NO: 438963 - DNA, 514 bp, Homo sapiens
  misc_feature: GZ8MTXP02IJ7B1.44.36.D03.1.454.CMB.2.raw
  modified_base (282)..(282): a, c, t, g, unknown or other
  modified_base (497)..(514): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggtccgtttatttctgtgcgaggcgagactggtctttcaatctagtggggccgtggccnccctggtcactgtctcctcagccttccaccgacggcccatcggtcccttcccccgtggccgcccctgcctccgaggacgccaccgtcgtcggggccacgacggccggcccgtggggcctcggccgtgggtaccgaaacggtaccttacgtttacctaatacttactggttcgtggacggtccggggtcgtcgggacgaagggccgacgagtaggnnnnnnnnnnnnnnnnnn

SEQ ID NO: 438964 - DNA, 630 bp, Homo sapiens
  misc_feature: GZ8MTXP02IQIWN.44.36.D03.1.454.CMB.2.raw
  modified_base (401)..(401): a, c, t, g, unknown or other
  modified_base (609)..(609): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaggtgtcagagtgagtgcagttggtggaggtccgggggagtacgttggtccaggccgtgggacgggtccctggagtacctctcctggtcgtcgcctctggacttcaccatcagtcaccactatagtggacgtcgggtcccgccgaggctaccggaggggacggggcgtgggagtggcgttgggccgacaaagtaaaacaagttcgacctagttctttancaacagtacgtaccgccgtcgttctagtacgaaacgccaagtacttcccacccttctacgaaagagtatacgtaccttaacaaacgtaaaccttgtaaacgtttgaacctttcgagaacgtaagtaacgtaaccctaaaacgtaacgaaaacccggtaggacgaacgggctaaagtgtttaattacgttgtttgtttaagtagtttanacgtcgaaggtactcgtaccg

SEQ ID NO: 438965 - DNA, 519 bp, Homo sapiens
  misc_feature: GZ8MTXP02FNGD7.44.36.D03.1.454.CMB.2.raw
  modified_base (330)..(330): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataagggtttgaatggatggtagggagctactctggcaatggtaacacaggctatgcacagaagtttcaggggcagagtcaccatgaccagggacacgtccacgagcacagcctacatggagctgagcagtcagagatctgaggacatagatgngtactactgtgcgagaccggtagaggacaagacaaagaaaagtaagttactttagactacgtaggggccaagggaacccgtggtcaccgtctcctcacgcctccaccaacgggcccagtccggtctccccctcggccacccgtcctaccacgacgccacgtcgtcgggggcacaggccgcccgtggccg

SEQ ID NO: 438966 - DNA, 708 bp, Homo sapiens
  misc_feature: GZ8MTXP02JUBFZ.44.36.D03.1.454.CMB.2.raw
  modified_base (316)..(316): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctggtggagtcgtgggggaggcttgggtacagggcgggggggtccctggagactctcctgtgcagcctcgtggattcatcttcagtgactatcgccagtgaacgtgggtcccnccgaggcctaccgaggggaacggggccgtgggacggttggggtttaccccagttagttaggtttaaattagtttggacgttgggaacgtacttacccccgtaaccttaactaccgactaacggtaaccttccgtaggttacggaaacgggggtaccctatttacccgaaaccctaaagtttccccgaaaggggtacccaaagtacggaacccaaaagtaacccttacaacttggtaactttccggaaagggtaaaacttcggaaaaccacgtaccgtaaggaacggtaacggaacggaacgggaacccgtacgggtcttacggttacccgttaacgtttcgttaaggttaccggaaggtacggtacggtcccgggtacctttacggttcggg

SEQ ID NO: 438967 - DNA, 644 bp, Homo sapiens
  misc_feature: GZ8MTXP02FMNBW.44.36.D03.1.454.CMB.2.raw
  modified_base (321)..(321): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccactgtgaggtgcggctgggtggagtcgtgggggaggtcgttgggtacgagggcgggggggtccctggagactctcctgtgcagcctctggattcattcttcagtgactatcgccatcgaacgtgggtcccnccgaggcctccggaggggaaggggctgggagttgggttccattattagttaattagttgcgtgggaagtactacccaccttactacgcaagtactcgttaggtagaacggggtccctaatttaccaacccttaaattcccgaagggaaccaagttcggaacccaaagaaccctcgaacttagtaactaccgtaaggaaaactacggaaacacgcctaggaaacgaacggaccggaagggaccacggtcgttacgttaccttaccgtttacgtaacggttaccggaaggtacggtacgtacccggggaccctttaggtttcggg

SEQ ID NO: 438968 - DNA, 566 bp, Homo sapiens
  misc_feature: GZ8MTXP02F99X9.44.36.D03.1.454.CMB.2.raw
  modified_base (302)..(302): a, c, t, g, unknown or other
  modified_base (341)..(341): a, c, t, g, unknown or other
  modified_base (372)..(372): a, c, t, g, unknown or other
  modified_base (445)..(445): a, c, t, g, unknown or other
  modified_base (469)..(469): a, c, t, g, unknown or other
  modified_base (498)..(498): a, c, t, g, unknown or other
  modified_base (503)..(503): a, c, t, g, unknown or other
  modified_base (532)..(532): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccncaggctccgaggggaggggctggagtggcttgggccganaaagtaaaaaacaagttcgaccagctttacncaacagcgtaccgccgcgttcgtgtagaaacgccaagtactttcccaaccctctacaaagagatcgaaccttnaaaacgtactcatttagatttcgngacgaatcgaacttaacgagaaaaccggngaacnggctattgtattagtgttgttagtattanatgaacgtactcgtacgacggtcggacctaacgg

SEQ ID NO: 438969 - DNA, 632 bp, Homo sapiens
  misc_feature: GZ8MTXP02FLM5T.44.36.D03.1.454.CMB.2.raw
  modified_base (402)..(402): a, c, t, g, unknown or other
  modified_base (473)..(473): a, c, t, g, unknown or other
  modified_base (551)..(551): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacaaggtgtccagagtgaagtgcaggttggtggaggtccgggggagacgttgggtccagccgtggagggtccctgagactctcctgtgtcgcctctggatcaccatcagtcgaccactatatggacgtcgggtccgccgaggcctaccgaggggaacggggctggggagtgggcgttgggccgacgaaagtaaaaaccaaggttcaccgtagtacttttanccaagaggacgtaccgaccgcgttactagtacgaaaacgcctaagtacttcccacccctctacgaaagtanatgtaaccttaacgaaagtaactctaatttcgaatttccgagactaaagtcgaaacctaaaccgtaggaaaaacccgnggaaccgacggggactaagttacgttaatttagttggttagtttggtttactttaatacgtacgaaggttactcggtaccg

SEQ ID NO: 438970 - DNA, 613 bp, Homo sapiens
  misc_feature: GZ8MTXP02I3NN8.44.36.D03.1.454.CMB.2.raw
  modified_base (208)..(208): a, c, t, g, unknown or other
  modified_base (308)..(308): a, c, t, g, unknown or other
  modified_base (377)..(377): a, c, t, g, unknown or other
  modified_base (393)..(393): a, c, t, g, unknown or other
  modified_base (457)..(457): a, c, t, g, unknown or other
  modified_base (512)..(512): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaggtgtccagagtgaagtgcagttggnggaggtccgggggagacttggtccagcctggagggtccctgagactctctgtgtcgcctctggattcaccatcagtgaccactatatggactcgggtccnccaggcctccggaggggaggggctgggagtggctggccgacaagtaaaaacagttcgaccagtctttancacagacgtacgccgngtctgtagaaacgccaagtactttcccacccttcacaaagagatcgaacttcgaaaataccgtntatttgatttcgtagaccggtaattcggaaacctaaaccgtacgaaaaacccggnggaaccgaacggggactaacgttaggtttaaatttacgttggtttagttaaggtttattttaaaccgtagtaccgtaaagggtaacctttcgtaaccccgg

SEQ ID NO: 438971 - DNA, 719 bp, Homo sapiens
  misc_feature: GZ8MTXP02JGRNW.44.36.D03.1.454.CMB.2.raw
  modified_base (265)..(265): a, c, t, g, unknown or other
  modified_base (279)..(279): a, c, t, g, unknown or other
  modified_base (387)..(387): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggatacttggtccagccgtggacgggtccctgagctctctgtgtcnctctggattcaccntcagtcgaccactatagtggacgtgggtcccgcaggcctcggaaggggagggctgggagtggcgttgggccacgaaagtaaaaaaccagttcgaccctaagtctttancaacgagacgtaccgccgtacgtctagtagaaaacgccaaggtacttacccaacccttcgaacaaaagggtacgaacttcgggtaaaaccctttaggaaaacgttaaacccctttacgtaaagtttacggtaacttttaccggaacggtaaacggtaaacttacggtaaaacccgttaaaacccggtaaaacgggaaaaacccgggtacggggaaacccggtacggggtaaaccttaagtttacggtttaacgtttacggtttggtttaggttttaagtttaaaggttttaaccgtacgtaacgtaacgggttaaaccgttccggttaccgg

SEQ ID NO: 438972 - DNA, 745 bp, Homo sapiens
  misc_feature: GZ8MTXP02I5VFG.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcgttgggtacgagggccggggggggtccctggacgactcgtcctggtgcagcctcgtggattcatcttcagtgactatgcctatgaacgtcgggtcccgcgacggcctaccggaggggaacgggcgtgggtaggttcggggtttaccagttagttaggtttaaattagtttcggtacgttgggggaacgtaaccttaaccccgtaaccttaaccgttaaccgacgtaaacggtaccttcgttacgggtagggaaaccgggggcccttaaatttacccgaaacccgttaaacgtttacccggaaaggggtaaacctaacggttaccgggaaaccctaaaaggaaaccctttccgaaaccgtttaggttaaaccgttaccgtaagggtaaaacttcggaaaacgtacggtaccgaaagacgggaaacgggaacggaacgggacgtaaccgggtcttacgttacgttacgttaccggttgttaacggacggtaaggtaccgttaccggggaccttacgggtttcgg

SEQ ID NO: 438973 - DNA, 632 bp, Homo sapiens
  misc_feature: GZ8MTXP02FX2D4.44.36.D03.1.454.CMB.2.raw
  modified_base (277)..(277): a, c, t, g, unknown or other
  modified_base (292)..(292): a, c, t, g, unknown or other
  modified_base (401)..(401): a, c, t, g, unknown or other
  modified_base (466)..(466): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaaggtgtccagagtgaagtgctagttgggtggaggtccgggggagacgttggtccaggccgtgggacgggtccctgagactctcctgtgtcgcctntgatcaccatcagtnaccatatagtggacgtcgggtccgccgaggcctccggaggggaaggggctggggagtcggcgttcggaccgaacaaacgtaaaaaaacaagttcgaccaagtactttancaacaggagtaccgccgtcgtctagtaacgaaacgtccaagtacttcccacccctctacaaaggnaatgaaaccttacgaaaataactactattagtaattccgtaggacgtaaattacgaaaccttaaaccgaaacggaaaaacccggaggaccgaggggactagttagttaatttagttgttaggtttaacttagtttaactacgtacgtaagtaacgtcgtaacccgg

SEQ ID NO: 438974 - DNA, 786 bp, Homo sapiens
  misc_feature: GZ8MTXP02G12G8.44.36.D03.1.454.CMB.2.raw
  modified_base (225)..(225): a, c, t, g, unknown or other
  modified_base (314)..(314): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttggtggaggtccggggganacgttggtccagccgtgggagggtccctgagactctctgtgtcgcctgtggatcaccatcagtcgaccactatatggacgtcgggtccnccgaggcctaccggaagggggtaacggggtcgtaggggacggtcggtcgttcggggaccgaccgtaaaaaggtaaaaaaacgtaaaggttcgaccctaaggttaccttttagccaaacgaaggtaacgttacccgccggcgttactagtaacgaaaacggcccaaaggtacctttcccaaaccccttccgaacgaaaaggtaacgtaacgttacggtaaaacctttacgaaaaacgttaaacccttattaaacgttttaggtaaactttacccgttgggaaaccggttaaattaacccgggtaaaaccctaaaacccggttaacgggaaaaaaaaccccgggtaggggaaaacccgaacccgggggtacttaaaggttaacggtttaaactttaacgtttggtttaggtttaacgtttaggttttaaaacttagtaacggtaaaaccggggtaactttcggttaaccccggg

SEQ ID NO: 438975 - DNA, 628 bp, Homo sapiens
  misc_feature: GZ8MTXP02FQKS4.44.36.D03.1.454.CMB.2.raw
  modified_base (223)..(223): a, c, t, g, unknown or other
  modified_base (313)..(313): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccggggganacttggtccagcctgggacgggtccctgagactctcctgtgtcgcctctggattcaccatccagtcgaccatatagtggactgggtcccncaggctccgaggggaacgggctgggacgtggcttgggaccacgaaagtaaaaaccagtttcgacctagtctttacncaacgagtacgtaccgcgtcgtcgtagtagaaacgcctaagtaccttacccaccctactacgaaagagtatacgtaaccttaacaaacgtacctatagttacgtacttcgagacgtaaagtacgaaacctaaaccgaaacgaaaaccggacggaaccgacggactagttagttaacgtttagttggtttagtttaagtttacgtttaacgttacgtacggtaacggtacctcggtaccg

SEQ ID NO: 438976 - DNA, 519 bp, Homo sapiens
  misc_feature: GZ8MTXP02F6EAC.44.36.D03.1.454.CMB.2.raw
  modified_base (309)..(309): a, c, t, g, unknown or other
  modified_base (423)..(423): a, c, t, g, unknown or other
  modified_base (446)..(446): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctatttagaaggtgtccactgtgaggtgcggctggtggagtcgtgggggaggcttgggtacgaggcggggggggtccctggagactctcctgtgcagcctctggattcatcttcagtgactatgccatgaactggtccncaggctccgaggggagggctggagtgggttccatatagtaatatgctggagataccacctactacgcagactctgtgaaggcattcactaatccgaggacatgaccaaagactnactagtatctaggaaatgaaacncgacagaagacgacgagacgacgtctcgtactacttacgtgtacgaagacggtacgtccgggactacgttcgg

SEQ ID NO: 438977 - DNA, 777 bp, Homo sapiens
  misc_feature: GZ8MTXP02FZ0HI.44.36.D03.1.454.CMB.2.raw
  modified_base (311)..(311): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttatttacaaggtgtccagagtgaagtgcaggttggtggaggtccgggggagacttgggtccagccgtgggagggtccctgagactctcctgtgtcgcctctggattcaccatcagtcgaccactatagtggacgtcggggtccnccgaggcctccggaagggggaacggggcgtaggggaggtcgggtcgttcggggacccgtaacgaaaaggtaaaaaaacgtaaaacggttccgaaccccgaggttacttttaaacaccgaaaccggtaaggtacggtacccggcccggtcggttaccgttaggtaaacggaaaacgcccgtaaagtacctttacccacccccgttatacgaaaagaacgtatacgtaaccttacgaaaataccttactagttagtaactttccgtaggtaaccgaaattacgtaaaaccccgttaaccgtaaacgggaaaaaaaccccggggagggaaaccggaaccgggtaactaaaggttacgttaaatttggttacggtttaggtttagtttaacgtttaagtaaccgtaacgggtaaacggttaccgttacggtacccggtaacggggtaccgggggaaccgtaaaccggggg

SEQ ID NO: 438978 - DNA, 628 bp, Homo sapiens
  misc_feature: GZ8MTXP02IXT56.44.36.D03.1.454.CMB.2.raw
  modified_base (270)..(270): a, c, t, g, unknown or other
  modified_base (309)..(309): a, c, t, g, unknown or other
  modified_base (381)..(381): a, c, t, g, unknown or other
  modified_base (533)..(533): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctntgattcacatcagtgaccactatatggacttgggtcccnccgaggcctccgaggggaaggggctgggagtggcttggccgacaagtaaaaacaagttgacctagtctttancaacagacgtaccgcgcgtctgtagaaacgccaagtacttccacccttctacaaagaagactagtaaccttacgaaaacgtaaaccttctaagtttagaactttccgtaggacgtaaatacgaaaccttaaaaccgagggaaaaaaccccgngggaaaccaaacgggggtccaaagtttacgttaattttaagtttggtttagtttgttagtttaacttagtacgaacgggtaacttcggtaacccg

SEQ ID NO: 438979 - DNA, 679 bp, Homo sapiens
  misc_feature: GZ8MTXP02I187X.44.36.D03.1.454.CMB.2.raw
  modified_base (420)..(420): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgctagttggtgggaggtccgggggagtacgttggtccagtccgtgggacgggttccctgacgtactctccttgtgtccgcctctggacttcaccatcagtcgaccactatagtggacgtcgggtccgaccaggcctaccggaggggaacgggcgtagggaggtggtccgttgggacccgacgaaaacgtaaaaaacaggttcgacctagttactttancaaacgaacggtacgtaccggccgtcgtcgtagtaagaaacgtccaaagttacttcccaaccctcgtaacgaaacgagtacgttacgtaaaccttacgaaaagtaaccttacgtaatttacgtacgtttacgtacgacgtaaataacgtaaacctaaaccgtaaaacgaaaaccggtacggacgtaacggactaagttacgttaaattagttagttgtttaagttagtttatacgtacgaaacgtcgtacgtaacccgg

SEQ ID NO: 438980 - DNA, 628 bp, Homo sapiens
  misc_feature: GZ8MTXP02H6HPR.44.36.D03.1.454.CMB.2.raw
  modified_base (275)..(275): a, c, t, g, unknown or other
  modified_base (307)..(307): a, c, t, g, unknown or other
  modified_base (384)..(384): a, c, t, g, unknown or other
  modified_base (420)..(420): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccggggagacttggtccagcctgggaggtccctgagactctctgtgtcgcctcgtggatcaccntcagtcgaccactatagtggactcggggtccnccagggcctccgaggggaaggggctgggagtgggcttggaccgacaaagtaaaaacagttccgacctaagtctttancacagagtaccggccgcgttctaggtacggaaaacnccaacgtactcccaccctcgaacgaagagtatacgtaactacgaaactactacttattacgtatttcgtagaacgtaagtacgtaaaaccgtaaaccgtaaacgaaaaccggaggaccgacggtactagttagtttattagttgttagtttagttatttatacgtaagtaacggtacgtcgtaccgtacgggtacgggaaccgtacgg

SEQ ID NO: 438981 - DNA, 614 bp, Homo sapiens
  misc_feature: GZ8MTXP02IYTBA.44.36.D03.1.454.CMB.2.raw
  modified_base (281)..(281): a, c, t, g, unknown or other
  modified_base (377)..(377): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccaggcctgggacgggtccctgagactctcctgtgtcgctctggattcacntcagtcgaccactatatggactgggtccgccaggctccgaggggaaggggctgggagtggcttggccgacaagtaaaacaagttcgccagctttancacagacgtacgcgcgtctgtgaaacgcccaagactttccaccctctacgaaagagatacgaacttacaaagtaacctctatttgaatttccgtgtaccggaattggaaacccttaaaacccgtaggaaaaacccggacgggtaaccgaacggggctaaagttacggttaatttaacgttggttagttttaagttaggtttttaaatgttaacgaacggtaaccgttgttaaccccg

SEQ ID NO: 438982 - DNA, 560 bp, Homo sapiens
  misc_feature: GZ8MTXP02F4SY0.44.36.D03.1.454.CMB.2.raw
  modified_base (349)..(349): a, c, t, g, unknown or other
  modified_base (376)..(376): a, c, t, g, unknown or other
tcagacagtatatacacgaccggtgctcgatttagctgcgtcacgatctctcttgggtcctgtcccaggtcaccttgaaggagtctggtcctgtgctggtgaaacccacagagaccctcacgctgacctgcaccatctctgggttctctctcaacgatattagaatgggtgtgagctggatccgtcagtccccagggaaggccctggagtggcttgcacacatcttctcgaatgaacgaaaatcctacagtacatctctgaagagcagtttaaccatctccaaggacacctacaaaggcaggtgtcttagtatgaccaacatggaccctgcgacaccagcacatatacngtgcacgggtaatgacggaaagaaacngacttggttctagtaattataagttctacctatctgacgtgtaggggacgaaacgggaccgtaccgtcaccgtctccctcacgtcctaccacgaacgccctacgtcccggtccttccccgtcggtccgtcccgtcgaccgtccgacgcgcctaccgtcggtacgggggcaaccggcggcccggg

SEQ ID NO: 438983 - DNA, 675 bp, Homo sapiens
  misc_feature: GZ8MTXP02HBS6M.44.36.D03.1.454.CMB.2.raw
  modified_base (223)..(223): a, c, t, g, unknown or other
  modified_base (303)..(303): a, c, t, g, unknown or other
  modified_base (316)..(316): a, c, t, g, unknown or other
  modified_base (404)..(404): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttatttacaaggtgtccagagtgaagtgcaggttggtggaggtccggggganacgttggtccaggcctgggagggtccctgagacctctcctgtcgtcgcctcgtggacttcaccatcagtgaccactatanggactggggtccnccaggctccgaaggggaggggctgggaggtggcgttgggccgacgaaacgtaaaaaccgtaaaggttcgacctaaggttacttttacnccgtaacgaaggtacgttaaccggcccgtacgttccgtagtacgaaaacggcccaaggtaccttcccgaacccttctaaacgaaacgggtaatacgtacgtaaaccttaacgaaaacgtaccttatagtttagtacttacgaggtaacgtaactacgtaaaccgtaaacgtaaacggaaaaccggtacggaaccgtacggactaggttaagtttaagtttagttggttacgtttaagttagtttaactagtacgtacgtacgtcgtaccgg

SEQ ID NO: 438984 - DNA, 628 bp, Homo sapiens
  misc_feature: GZ8MTXP02FZ7WA.44.36.D03.1.454.CMB.2.raw
  modified_base (390)..(390): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggagtccgggggagacttggtccagcctggaggtccctgagactctcctgtgtcgcctctggattcaccatcagtcgaccatatagtggacgtgggtcccgccgaggcctccggaggggaacggggctgggagtggcgttgggccgacaaagtaaaaacaaggttcgacctagtctttancaacgagacgtaccgccgtcgtctagtagaaacgccaagtacttcccaccctctacaaagagatcgaacttacgaaagtactctatttaggaactttccgagtaaccgtaattacggaaacccttaaaccgtaacggaaaaaccccggaggaaaccgacggggtactaaagttaggttaatttagttgtttggtttgtttagtttaatacgttaccgaaggtaacctcggttaacccg

SEQ ID NO: 438985 - DNA, 808 bp, Homo sapiens
  misc_feature: GZ8MTXP02JJZ4K.44.36.D03.1.454.CMB.2.raw
  modified_base (210)..(210): a, c, t, g, unknown or other
  modified_base (225)..(225): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggnggaggtccggggganacgttggtccagcctgggagggtccctgagactctcctgtgtcgcctcgtggattcaccatcagtcgaccactatagtggactgggtcccgccgaggcctaccggaggggaacggggcgtagggaggtggtccgttcggggcccgaaccgtaaagtaaaaaaccgtaaaggtttcgaccctaaggttaccttttacgaccgaacgtaagggtaccgtacccgcccggtacgtaccgtagggtacgaaaacggtcccaaaggtacctttaccccgaaccccctttcgaaccgaaaaggtacggtaaacttacggtaaaccctttaaccgaaaacggttaaacccttccgtaaacgttttggtaaaccttttacccgaggtaaccgtaaagttaccgggtaaaacccttaaaacccgggtaaacgggaaaaaaccccgggtacggggaaacccggaaaccgggggaccttaaaggtttacggtttaacttttaacggttttcgggtttaggttttaaggggtttactttttaaacggtaactttaccggtaaacggggtttaaaccttcgggttaaacccccggg

SEQ ID NO: 438986 - DNA, 782 bp, Homo sapiens
  misc_feature: GZ8MTXP02IT7TY.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaggtgtccagagtgaagtgcaggttggtggaggtccgggggagacgttggtccagcctgggagggtccctgagactctcctgtgtcgctctggattcacatcagtcgaccatatagtggacgttgggtcccgccgaggcctaccggaagggggacggggtcgtaggggaggttcgggcgtttcggggcccgaccgtaaaacggttaaaaaaaccgtaaagggtttaccgacctaaggttaccttttacgtaccaaacgacgggtaaacgtacccggcccggtcgttactacggggtagaaaacggcccaaaggtacttttaccccaaccccttccttaacgaaaacggagtaacttacggtaaaccctttaaacgaaaacggtaaaccctttgttaagtttacgtaacctttcgtaacggaacgttaaacgttaaccggttaaacccgttaaaaccggtaaaccgggaaaaacccgggacgggaaacccgtaaccggggtactaaagtttacggtttaagtttacgtttgggtttagttttaagtttaaagttttaacgttaacgtaccggtaaaacggttaaccgtttaccggtaccccg

SEQ ID NO: 438987 - DNA, 661 bp, Homo sapiens
  misc_feature: GZ8MTXP02G8I87.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagtacgttgggtccaggccgtgggacgggtccctggacgactctccgtgtgtccgcctcgtggattcaccatcagtcgacctactatagtggacgtgggtccgccaggcctccggaggggaggggctgggagtgggtcgtgggccgacgaaagtaaaaaccgagttcgaccagttctttatcaacgagtacgtaccgccgtcgtcgtagtagaaaccgccaagtacttcccaacccgtctaacgaaagtagtactacgtaaccgttacaaaacgaaccttctaagtttcgtatttacgacgtaaccgtaaataccggaaaacccttaaaccgaacggaaaaacccggtggaaaccgtacggggacttaagtagtttaaattcgtttaggttagtttgttacgtttaatacggtctaaacggttactcggtaaccg

SEQ ID NO: 438988 - DNA, 553 bp, Homo sapiens
  misc_feature: GZ8MTXP02F8JUE.44.36.D03.1.454.CMB.2.raw
  modified_base (303)..(303): a, c, t, g, unknown or other
  modified_base (373)..(373): a, c, t, g, unknown or other
  modified_base (418)..(418): a, c, t, g, unknown or other
  modified_base (452)..(452): a, c, t, g, unknown or other
  modified_base (482)..(482): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccnccagggcctccgaggggaggggctgggagtgggcttgggccagaagtaaaaacaagttcgccagtcttancacagagtcgccgcgtctgtagaaacgccaagtacttccaccctntacaagagatgacttacaaagactcattgattcngacgaatcgaactaaccgtagaaaaccggngacgacggcagttagtattattgtgttgttagttatatgaaggtactcgaccacgtcgggacctaacgggg

SEQ ID NO: 438989 - DNA, 607 bp, Homo sapiens
  misc_feature: GZ8MTXP02HY0DR.44.36.D03.1.454.CMB.2.raw
  modified_base (280)..(280): a, c, t, g, unknown or other
  modified_base (320)..(320): a, c, t, g, unknown or other
  modified_base (346)..(346): a, c, t, g, unknown or other
  modified_base (384)..(384): a, c, t, g, unknown or other
  modified_base (387)..(387): a, c, t, g, unknown or other
  modified_base (515)..(515): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgtaggttggtgggaggtccgggggatacgttgggtccagccgtgggacgggtccctgagactctcctgtgcgcctntggacttcaccatcagtgaccatatatggacgtcgggccncgaggcctacggaggggagggctggngtggctggccacaaagtaaaaacagtcgctagtcttancanagagtacgcgctctgagaaagcagtacttccacctcacaagagtatacgacttacaaagtacttactaagttgtaacgtttcgaggacctaaagtacgaaaccttaaaccgaaacggaaaaacccggnggaaaaccgacgggaactaagttacgttaactttagtttggttagtttcgttagtttaaacgtagtacgtaacggtactttacgtaacccgg

SEQ ID NO: 438990 - DNA, 581 bp, Homo sapiens
  misc_feature: GZ8MTXP02I9N80.44.36.D03.1.454.CMB.2.raw
  modified_base (205)..(205): a, c, t, g, unknown or other
  modified_base (219)..(219): a, c, t, g, unknown or other
  modified_base (302)..(302): a, c, t, g, unknown or other
  modified_base (374)..(374): a, c, t, g, unknown or other
  modified_base (428)..(428): a, c, t, g, unknown or other
  modified_base (515)..(515): a, c, t, g, unknown or other
  modified_base (528)..(528): a, c, t, g, unknown or other
  modified_base (534)..(534): a, c, t, g, unknown or other
tcagacagtatatacacgaccggtgctcgatttagctgcgtcacgatctctcttggggagctctgagagcggagccccagccccagaattcccaggtgtttcatttggtgatcagcactgaacacagaggactcaccatggagttcgggctgagctgggtttcctgttgttatttacaaggtgtccagagtgaagtgcagttggnggagtccggggganacttggccagcctggacggtccctgagctctcctgtgtcgcctctggattcacatcagtcgaccatatagtggactgggtccncaggctccgaggggagggctggagtggcgttgggccacgtaaagtaaaaacaaggttcgacctagtctttancaacgagacgtaccgcgtcgtctagtacgaaacgcccaagtacttccacccctntacgaaaggacatacgtaaccttacaaagtaaccttcaagttgtaattccgtaggacgaattcgaaccctaaacgtagaaaacccgnggaaccgacgggntaagtnttaattagttgtagttgttatttactagacgtacgtactcgtaaccg

SEQ ID NO: 438991 - DNA, 696 bp, Homo sapiens
  misc_feature: GZ8MTXP02F3XZD.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctcgaatgaacgaaaatcctaacagtacatctctagaagagactagtttaaccatacctaccaaggaccacctaccaaaaggcgaggttggtactttagtatcgaacccaaacagttacgacccctgaccggaacaccccgaggaccaactaattaacttacgtggttcggacgaacggggtaaagtggaacgggaaaagaaaccgagtcgttaggtttctagttaattaacgttaaagttacttaaccgtattacgtacggtaacgtcgttagggggaacgaaaacggggtacccgtaaccgggtaccgtaacccggttacctacccgtaccgtaacggtcccttaccgaacccgtaaacgggcccctaacgtcccggttaccctttcccccgcggtcccgtcccgttccgccctccggacggaaccgtcccgacccgttcggccgggggaccaccggacgcccgggg

SEQ ID NO: 438992 - DNA, 657 bp, Homo sapiens
  misc_feature: GZ8MTXP02JKUA8.44.36.D03.1.454.CMB.2.raw
  modified_base (317)..(317): a, c, t, g, unknown or other
  modified_base (326)..(326): a, c, t, g, unknown or other
  modified_base (402)..(402): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctaacagtacatctctagaagagcagtttaaccatctaccaaggacacctacaaaggcaggtggtcttagtangtaaccaanatcggaccctgacggacaccaggtacactatacttactgtgcgaacggggtaatacgggacggggaaaagaaaacngtacgttgggttttataggttaattaagttaaacgttacttaacccattcgttacggacgttcggtacgggggacgaaaacggggacccgtacgggtaccctaccggttaccctcctaccgaacgtccttaccccgaaaccgaaccggggtccctaacgtcccgggtttccccttccccgtcgggccccgtcccgttcggccctccgaggaacgaccgtaccccgttggacgggggaccaacggcggccccgggg

SEQ ID NO: 438993 - DNA, 644 bp, Homo sapiens
  misc_feature: GZ8MTXP02G4AJA.44.36.D03.1.454.CMB.2.raw
  modified_base (295)..(295): a, c, t, g, unknown or other
  modified_base (332)..(332): a, c, t, g, unknown or other
  modified_base (419)..(419): a, c, t, g, unknown or other
  modified_base (500)..(500): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggagggtccgggggagtacgttgggtccaggtcccgtggggacggggtcccctggacgactctccgtgtgtccgccctgtggntccaccatcagtcaccatatagtggacgtcgggcccncgaggcctaccggaggggaacggggcgtgggagtgggtccttggggccgtaacaaagtaaaaaacctagttcgacctagtactttancaagagacgtccgccgctcgtgtagaaacgcagtactcccaccctctacaacgagtactacgtaacttacaaaacgactanacgttagaacttcgtacgaacgtaatacgtaaacctaaaccgtaaaacggaaaacccggaacggaaccgacggggtactagtagttaacgtttagttgttagttggtttatttaagtacgttagaacggtaccgtacgtaccgg

SEQ ID NO: 438994 - DNA, 632 bp, Homo sapiens
  misc_feature: GZ8MTXP02IIN0D.44.36.D03.1.454.CMB.2.raw
  modified_base (375)..(375): a, c, t, g, unknown or other
  modified_base (608)..(608): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctccaccctcctcactcactgtgcagggtcctgggcccagtctgttttgactcagccaccctcaacgtcgtcgggacccccggcaggagggtcatcatctcttgttctggaagcagtccaacatcggaccctaattctgtatatgtacagcagtccaggaccgaccccaactcctcatctataggactaatcagccgccctcgacggggtcccctagaccgtattctccgtcggcctaccaagtctcggaccncctcacgtcccctccctgggcctactccgacggtccggggcccccggtcccggagggtaccggagggtttcgacttactacgtcgacgcgaggtccgttggggacgttacgacccggtcgtaggacgggtcgttgggtcgtcgggttcgggacggggacgggtaaccctaaaacgtcgtacccggtacgtacgggtacacgacccgaacggtcgccgcccccgtacgggtccncgtccgttccgtacccctaccccg

SEQ ID NO: 438995 - DNA, 587 bp, Homo sapiens
  misc_feature: GZ8MTXP02FXRTR.44.36.D03.1.454.CMB.2.raw
  modified_base (307)..(307): a, c, t, g, unknown or other
  modified_base (369)..(369): a, c, t, g, unknown or other
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggagggtccctgagactctcctgtgtcgcctctggattcaccatcagtgaccactatatggactgggtccncaggctcgagggagggctgggagtggctggccgacaagtaaaaacaagttgccagtctttancacagacgtacgccgagtctgtagaaacgccaaagctttaccaacccccttntaacaaagatactacgtaaccttacaaaagtactatattacgtattcgagacgtaatacgaaacctaaaccgacggaaaaccgaggaccgaacgggactaagttagttaatttagttggttacgtttgttacgtttaatacgtacgaaacggtacgttcgtaaccg

SEQ ID NO: 438996 - DNA, 627 bp, Homo sapiens
  misc_feature: GZ8MTXP02H1ECR.44.36.D03.1.454.CMB.2.raw
  modified_base (216)..(216): a, c, t, g, unknown or other
  modified_base (267)..(267): a, c, t, g, unknown or other
  modified_base (380)..(380): a, c, t, g, unknown or other
  modified_base (524)..(524): a, c, t, g, unknown or other
  modified_base (575)..(575): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtgaggtccgggganacttggtccagcctgggaggtccctgagactctcctgtgtcgcctcgtggnttcaccatcagtgaccactatagtggactgggtccgccagggcctaccgaggggaaggggctgggaggtgggcttgggccgaagaagtaaaaacaagttcgaccagtctttancacgagtacgtacgccgtcgtcgtgtagaaacgcccaagtacttcccgaacccctctacgaaagtacgaattcgaaacttacgaaagtaaactctaattgactttcgagaccgtaaatgaaacctaaccgtaaggaaaacccgnggaaccgtacgggactaagtaggtttataatttggtgtttagagttttaanattccgaaaggtaacttccgtacgtaccggtcggggtaaccccgaaccgggg

SEQ ID NO: 438997 - DNA, 625 bp, Homo sapiens
  misc_feature: GZ8MTXP02JYK5R.44.36.D03.1.454.CMB.2.raw
  modified_base (316)..(316): a, c, t, g, unknown or other
  modified_base (385)..(385): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtggagggtccctgagactctcctgtgtcgcctctggacttcaccatcagtcgaccactatagtggactcgggtcccnccgaggctccgaggggacggggctgggagtggcttggccgacaaagtaaaaacagttgccagtctttancaanagacgtacgccgtcgtctagtagaaacgcccaagtacttcccaacccctctacgaaagagactacgaactttacgaaaagtaaccttcaagtttagaactttcgagtacgtaaattacggaaaccttaaaccgaacggaaaaaccccggagggaaacccgacggggtactaaagttcgttaacgtttagtttggttagtttgttacgtttaatagtaccgaggtaacctgtacccg

SEQ ID NO: 438998 - DNA, 751 bp, Homo sapiens
  misc_feature: GZ8MTXP02JWT74.44.36.D03.1.454.CMB.2.raw
  modified_base (287)..(287): a, c, t, g, unknown or other
  modified_base (293)..(293): a, c, t, g, unknown or other
  modified_base (318)..(318): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagtacgttggtccaggccgtgggacgggtccctgacgactctcctgtgtcgcctctggattcaccntcagtnaccactatatggacgtcgggtcccnccgaggcctaccggaggggaagggctgggagtggctgggccgacaaacgtaaaaacagttcgccagtctttacacgaacgaggtacgtaccgccgcgttctaggtagaaaacgtcccaaaggtactttaccccaacccctttacgaacgaaaaggagtacgttacggtaaacccctttagaaaacggtaaacccttctaaaggtttcgtaaactttccctaggggtaaccctaaagtttacgtaaaaccccttaaaacccggttaaaacggaaaaaaacccccggggaggggtaaaacccccgtagggggaaacccttaaaggtttacggttttaaacttttaaaggttttggttagggtttttaaccgtttaaggtttttaaaccaaggttaaccgttaacggggtaaaacccgtttcgggtaaacccccgg

SEQ ID NO: 438999 - DNA, 582 bp, Homo sapiens
  misc_feature: GZ8MTXP02IZH13.44.36.D03.1.454.CMB.2.raw
  modified_base (227)..(227): a, c, t, g, unknown or other
  modified_base (276)..(276): a, c, t, g, unknown or other
  modified_base (316)..(316): a, c, t, g, unknown or other
  modified_base (391)..(391): a, c, t, g, unknown or other
  modified_base (438)..(438): a, c, t, g, unknown or other
  modified_base (446)..(446): a, c, t, g, unknown or other
  modified_base (477)..(477): a, c, t, g, unknown or other
  modified_base (508)..(508): a, c, t, g, unknown or other
tcagacagtatatacacgaccggtgctcgatttagctgcgtcacgatctctcttggggagctctgagagcggagcctcagccccagaattcccaggtgttttcatttggtgatcagcactgaacacagaggactcaccatggagttcgggctgagcttgggttttccttgttgtttattttacaaggttgtccagagtgaagtgcagttggtggaggtccggggganacgttggtccagccgtgggagggtccctgagactctcctgtgtcgcctntggattcaccatcagtgaccactatatggactgggtcccnccgaggcctccggaggggagggctgggagtggcgttggccccgacgaagtaaaaacaagttcgaccagtctttancacgagacgtacgccgctctgtagaaacgccagtacttccacccctntacaaagnatgaaccttacgaaagtacttcattcattcngacaatcgaaactaaccgtaagaaaaccggnggaacgacggtatagtttagttaactttgttgttaaggtttagtttagtttaacacgtacgtaacggtacttcg

SEQ ID NO: 439000 - DNA, 765 bp, Homo sapiens
  misc_feature: GZ8MTXP02GQWLT.44.36.D03.1.454.CMB.2.raw
  modified_base (280)..(280): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgttgggtccaggccgtgggtacgggtccctggagactcctcctgtgtcgcctntggattcaccatcagtcgaccactatagtcggacgtcgggtcccgccgaggccgtacccggaagggggaacggggcgtaggggagtcgggtcgttcgggccgacgtaaacggtaaaaacaaggttcgaccgtagtacttttagccaacgacggtacgtacccgccggtacgttcgtaggtagaaaaccgtcccgaaacgtacctttacccgacccccttacgtaccgaaaggtacgtaacgttacggtaaacctttaaccgaaaacggtaaccctttacgtaagttttaggtactttaccgtacggtaaccgtaaaagttaccggtaaaccccttaaaaccgttaaaaccgggaaaaacccggacgggaaacccgtaaccggggactaaaggtttacgttaaacgttttagtttggggtttagttttaacggtttagttttaacgttacgtaccggtaaacggtaaccgtttcggttaaccccgg

SEQ ID NO: 439001 - DNA, 579 bp, Homo sapiens
  misc_feature: GZ8MTXP02JZ80L.44.36.D03.1.454.CMB.2.raw
  modified_base (273)..(273): a, c, t, g, unknown or other
  modified_base (377)..(377): a, c, t, g, unknown or other
  modified_base (395)..(395): a, c, t, g, unknown or other
  modified_base (511)..(511): a, c, t, g, unknown or other
  modified_base (558)..(558): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcagttggtggagtccgggggagacttggtccagcctggagggtccctgagactctcctgtgtcgcctctggnttcaccatcagtgaccactatatggactcgggtccgccgaggctccgaggggaggggctggagtggcgttggccgacgaagtaaaaacaagttgacagtctttncacagagtcgccgcgtcngtagaaacgccagtacttccaccctctacaagacgatacgtacttacaaacgtaactctaatttggtaatttcgagtacgtaaatcggaaacctaaaccgtaaggaaaaacccggnggaaaccgacgggctaagtcgtattacgttgtgtttgttcttttaanactcgaggtaactcgtacccg

SEQ ID NO: 439002 - DNA, 704 bp, Homo sapiens
  misc_feature: GZ8MTXP02H5K71.44.36.D03.1.454.CMB.2.raw
  modified_base (334)..(334): a, c, t, g, unknown or other
  modified_base (336)..(336): a, c, t, g, unknown or other
  modified_base (342)..(342): a, c, t, g, unknown or other
  modified_base (356)..(356): a, c, t, g, unknown or other
  modified_base (363)..(363): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaacggccctggagtggcttgcacacattcttctacgaatagaaacgtaaaactcctacagtacatctctagaagagactaacgtttaaccatctacgaagaccactacaaaggctaggtgtattagtatagacaanancgaccngcgacacgagacanatatacngtgaccgtaaggtaagtggaacggtaaaagaaactagtacttaggtttactagttaattaacgtaaagttaccttaacgattacggtacggtaccggtttcggtaacggggaaaccgaaaacggggtaccctaaaccggggtacctaaccccgggttcctacccgtaccgtaaccgggtcccttaacccccgaaacggtaacccgggtaccccgtaaacgtttccccgggttacccccgtttcccccggcggttaccccgccccgttcgacccgttaccgtacggtaaccgacccgttacccgtcgggggtaccgggaccctaacggaccgcccccggggg

SEQ ID NO: 439003 - DNA, 519 bp, Homo sapiens
  misc_feature: GZ8MTXP02HDOGE.44.36.D03.1.454.CMB.2.raw
  modified_base (506)..(519): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggtccgttttatttctgtgcgaggcgagactggtctttcaatctagtgggccgtggcaccctggtcactgtctcctcagcttccaaccgaacgggccccagtccggtccttccccccgtggccgcccctgcctccgaggacgccacctcgtcgggggccacgacggccggcccgtggggctcggcccgttgggtaccaaacggggtaccttaccgtttaccctaattaacttactcggttcctggacggccggggtctgggacgaaacgggccgacagtaggnnnnnnnnnnnnnn

SEQ ID NO: 439004 - DNA, 578 bp, Homo sapiens
  misc_feature: GZ8MTXP02JZROD.44.36.D03.1.454.CMB.2.raw
  modified_base (330)..(330): a, c, t, g, unknown or other
  modified_base (352)..(352): a, c, t, g, unknown or other
  modified_base (387)..(387): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtgggtccagcaatgacattgggagatataaccttgtctcctggtatcaacaacatccaggacaaacgcccccaaatctaatacttttgagtccagtgacgcggccgtnaggtgtttctaatcgtcttctntcggctccaagtctggccacgacggccctcccgtntcgacttcctcgtcgggcctccggcctgacggacgaggctgactagttactggcgtctacgtacttaccaacttcttgtacgtacgtttcggggtggttcgggcgggtaacgggtcctaccgtacccgtcggtaaccccgttccgtacggttaccgaccggtacccgaaacggtcccgtaccgtccccccg

SEQ ID NO: 439005 - DNA, 703 bp, Homo sapiens
  misc_feature: GZ8MTXP02HKQ2I.44.36.D03.1.454.CMB.2.raw
  modified_base (217)..(217): a, c, t, g, unknown or other
  modified_base (309)..(309): a, c, t, g, unknown or other
  modified_base (388)..(388): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacgttggtccagcctgggacggtccctgagactctcctgtcgtcgcctctggattcaccatcagtcgaccatatagtggactcggggtcccnccgaggcctaccggaggggaaggggctgggagtgggtcgttggccacgaaagtaaaaactagtccgaccagtctttaancaacgagtcgtaccgcgtcgtctgtacgaaaacgcccaagtaacttcccacccgtctacgaaagagtactacgtacttacgaaagtacttagaagtttagacttttacgacggtaacgtaaacttaccggaaaaccttaaacccgtaacgggaaaaaacccgggagggtaaacccggaaccggggtactaacggtttaggtttaaagttttaacgtttgggtttacgtttaccggtttagttttaaattacgtaaccggtaaaggtaacttccgggtaaccctacggggtacgggggtaacccctaaaccggggg

SEQ ID NO: 439006 - DNA, 722 bp, Homo sapiens
  misc_feature: GZ8MTXP02GAZAW.44.36.D03.1.454.CMB.2.raw
  modified_base (327)..(327): a, c, t, g, unknown or other
  modified_base (348)..(348): a, c, t, g, unknown or other
  modified_base (444)..(444): a, c, t, g, unknown or other
  modified_base (490)..(490): a, c, t, g, unknown or other
  modified_base (553)..(553): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacgaaggtgtcagagtgaagtgctaggttgggtggaggtccgggggagtacgtttgggtccaggtccgtgggacgggttccctggacgactcgtcctgtcgtccgccttcgtggacttacaccatcgagtacgaaccctagttaanagttggacgttcggggtcccnccgaggccgtaccggaaggggaacggggtcgtaggggagtgggtccgttggaccgacgtaaaagtaaaaaaccgagttcgacctaagtacttttanaccgaacgtaggtacgtaccgccgtacgttcgtagaaacgaaaacnccgtaaatacttacccacccgtctaacgaaagtagactagaaacctttacgaaaataaccttntaattacgtacttacgagtacgtaaacgtaccgtaaactaaaccgtaaaacggaaaaccggtacggaaaccggtacgggtaactaagtttaagtttaagtttagtttggtttacggtttaagtttacgtttaaatacgttaacggtaacggttaccgttacggtaccgg

SEQ ID NO: 439007 - DNA, 734 bp, Homo sapiens
  misc_feature: GZ8MTXP02GFBG6.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttgggtgggaggtccgggggagacgttggtccagccgtgggagggtccctgagactctcctgtgtccgcccctggacttcaccatcagtcgaccactatagtggactggggtcccgccgagggcctccggaaggggaacggggtcgtaggggaggtgggccgttcggggacccgacgaaaacggttaaaaaaccaaaggtttcgaccctaaggttaccttttaatccgaaacgtaaggaacggttacccgcccggtcggtttccgtaggtacggaaaacgccctaaaggtactttacccaaccccttctaccgaaaaggtacggtaattacggaacctttaacgaaaacgtaaaccttactaaagtttcggtaactttccgttaggaacgtaaattacggaaaacccttaaaccgtaacggaaaaacccggagggaaccgacggggacctaagtttaggttaactttagtttggtttaggtttagttaagtttatacgtaccgtaaggtaacttcggtaccgtacgggg

SEQ ID NO: 439008 - DNA, 628 bp, Homo sapiens
  misc_feature: GZ8MTXP02FYYQI.44.36.D03.1.454.CMB.2.raw
  modified_base (397)..(397): a, c, t, g, unknown or other
  modified_base (483)..(483): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccatccgtggacgggtccctggagactctcctgtgtcgcctcgtggattcaccatcagtcgaccactatagtggacgtcgggtccgccgaggcctccggaggggaaggggctggggagtggcgttcgggccgacaaagtaaaaacaagttcgaccagtactttancacgagacgtaccgcgtcgtctgtagaaactccaagtactttcccaccctctacgaaagacgactgtaaccttacgaaataccttnaacgtttgtaattccgtagaccggtaaatacgtaacctaaaaccgtaacggaaaaccgaggaacccgtaagggctaaagttaggttaatttagttggttagtttggtttagtttaagtacttacgaacggtaactcggtacccgg

SEQ ID NO: 439009 - DNA, 660 bp, Homo sapiens
  misc_feature: GZ8MTXP02FZTWJ.44.36.D03.1.454.CMB.2.raw
  modified_base (279)..(279): a, c, t, g, unknown or other
  modified_base (320)..(320): a, c, t, g, unknown or other
  modified_base (386)..(386): a, c, t, g, unknown or other
  modified_base (543)..(543): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctgggtggagtcggtgggggaggtcgttgggtacgagggccggggggggtccctggagactctcctgtgcagcctntggattcatcttcagtgactatgctatgaacgtgggtcccnccgaggcctccggaggggaagggcgtgggagttgggtttaccattagtagttaatattgcgtgganactacccacctactacgcagacttcgtggtaggaacgggtcctaatttaccgaaccttaaacgttacccggaaggggaaacctaaagtaccggaacccaaaaaggtaacccttccgaacgtttacgtaagttaccgtaaggtaaaactgaaaaccgngacccgtaggaaacggtaacggaacggaagggaaccgaccgggtcttcggttacccttaacgtttcgtaacggttacggaagtacggtaccgttacggggacccttaagtttcgggg

SEQ ID NO: 439010 - DNA, 616 bp, Homo sapiens
  misc_feature: GZ8MTXP02HZSVJ.44.36.D03.1.454.CMB.2.raw
  modified_base (210)..(210): a, c, t, g, unknown or other
  modified_base (276)..(276): a, c, t, g, unknown or other
  modified_base (390)..(390): a, c, t, g, unknown or other
  modified_base (408)..(408): a, c, t, g, unknown or other
  modified_base (442)..(442): a, c, t, g, unknown or other
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagctgggttttccttgttgttattttacaaggtgtccagagtgaagtgcagttggnggaggtccgggggagacgttggtccagccgtgggacgggtccctgagactctcctgtgtcgcctcnggacttcaccatcagtgaccactatagtggacgtggtcccgccaggcctaccgaggggaagggcgtggagtggcgttcggccgacgaaagtaaaaacagttgaccagtctttancaacagacgtacgcccgnttctgagaaagcccaagacttcccaccccgttanaacgaagatagtacgaacttaacgaaacgtaactctagttacgtattcgacgacgtaacgtaacgtaaacctaaaccgaaacggaaaaaccggaggaaaccgacggtactagttagttacttagttcggttgtttaagttagttaactacgtacgtaacggtacttacggaccg

SEQ ID NO: 439011 - DNA, 602 bp, Homo sapiens
  misc_feature: GZ8MTXP02JTVHQ.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttaaagtgtccagagtgaagtgcagttggtggaggtccgggggagacttggtccagcctggagggtccctgagactctcctgtgtcgcctctggattcaccatcagtgaccactatatggactgggtccgcaggctccgaggggaaggggctggaggtggcgttggccgcaacgtaaaaacgaaagttgaccagtcttatcacagagtacgcgctctatgaaagccagattccaccctctacaaagagtatcgaacttacaagtaaactctaagttgaactttctagaccggtaaattacgaaaccttaaaccctaacgggaaaaaccccgaggggaaacccgacgggggctaacgttaggttaatttagttaggttgtttagttgtttaaacgtattacgaaggtaaaccttggtacctaaggg

SEQ ID NO: 439012 - DNA, 651 bp, Homo sapiens
  misc_feature: GZ8MTXP02IHO6U.44.36.D03.1.454.CMB.2.raw
  modified_base (350)..(350): a, c, t, g, unknown or other
  modified_base (377)..(377): a, c, t, g, unknown or other
  modified_base (396)..(396): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtcgaccactatatggactgggtccgccaggctccgaggggaaggggctgggagtggcttggccganaagtaaaaacaagttcgccagctttancacagacgtacgccgcgtntgtagaaaacgcccaagactttacccgaacccccttctaacgaaaggacgaattacggaaacctttaccgaaaacgtaaaccttctaaagtttcggaaacttttccgtaggaccgtaaattacggaaaccttaaaacccgtaggaaaaaaccccggtagggaaaccgtaccggggactaaagttacgttaacttttaagttgtttaggtttaagttagtttttaacaagttcgtaacggaactttcggtaacccg

SEQ ID NO: 439013 - DNA, 557 bp, Homo sapiens
  misc_feature: GZ8MTXP02GQ9MU.44.36.D03.1.454.CMB.2.raw
  modified_base (191)..(191): a, c, t, g, unknown or other
  modified_base (225)..(225): a, c, t, g, unknown or other
  modified_base (236)..(236): a, c, t, g, unknown or other
  modified_base (371)..(371): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcaatgganccagcgtaatnttctagtcttaacttgtctctgtatcaacatcatccaggtaaacgccccaaactcatcatctatgaggacctaataagacggccctcgaggggtttctaactcgcttcactgcctcagtccgcaacacgcctccnacatctctggctcagctgagacgagctgattattatgttgctcgagtattgttcgttcgctaacttctaactttaattcgttacgttaccgggtaaaggttcgggaaccgtaaaacgggtcctaccggttacccgtaaggttacacggtaccccgaacgggaccccaaaccccgtacgtttaaccg

SEQ ID NO: 439014 - DNA, 687 bp, Homo sapiens
  misc_feature: GZ8MTXP02JGOQB.44.36.D03.1.454.CMB.2.raw
  modified_base (292)..(292): a, c, t, g, unknown or other
  modified_base (409)..(409): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctgagcgttgggttttccttgttgttattttacaaggtgtccagagtgagtgcagttggtggaggtccgggggagtacgttggtccagccgtgggacgggtccctgagactcctcctgtcgtcgcctctggacttcacctntcagtcgaaccactatagtggacgtcgggtcccgcgaggccgtaccggaggggacggggctgggaggtggcgttcggaccgacgaaacgtaaaaactagttcgactagttctttacncaacgtacggacgtaccgccgtacgttcgtagtacgaaacgccgtaacgtacttaccctaccccgtctaaccgaaagggactacgtacgtaaacctttaaacgaaaccgttaactacgtatttacggtaattccggtagaaacgttaataaccggtaaaccttaaaccgaaacgggaaaacccggtacgggaaccgacgggtaactaagttagtttacgtttaagttggtttagtttggtttaactttatacgacgtaacggttacgtcgtacccggg

SEQ ID NO: 439015 - DNA, 637 bp, Homo sapiens
  misc_feature: GZ8MTXP02H3MVZ.44.36.D03.1.454.CMB.2.raw
  modified_base (401)..(401): a, c, t, g, unknown or other
  modified_base (494)..(494): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaggtgtccagagtgaagtgctaggttggtggaggtccgggggagtacgttgggtccagccgtgggacgggtccctggagactctccgtgtgtcgcctctggattcaccatcagtcgacctactatatggacgtgggtcccgccgaggcctccggaggggaaggggctagggagtggcgtcgggccgacgaagtaaaaaacaaggttcgaccagtcctttanccaacgaggaacgtaccgccgtcgtacgtgtacgaaaacgcccaagtacttcccacccttctacaaagagatacgacttacaaagtaaccttntagttgattcgagacgtaaatacgtaaaccctaaccgtaaaacggaaaaacccggacggaaaccggacggtactaagttacgttacgtttacgttggttgtttaaggttatttaacgtactacgtaacggtaacttcgtaccg

SEQ ID NO: 439016 - DNA, 615 bp, Homo sapiens
  misc_feature: GZ8MTXP02J4JC0.44.36.D03.1.454.CMB.2.raw
  modified_base (222)..(222): a, c, t, g, unknown or other
  modified_base (293)..(293): a, c, t, g, unknown or other
  modified_base (360)..(360): a, c, t, g, unknown or other
  modified_base (377)..(377): a, c, t, g, unknown or other
tcagacagtatatacacgaccggtgctcgatttagctgcgtcacgatctctcttggggagctctgagagcggagccccagccccagaattcccaggtgttttcattggtgatcagcactgaacacagaggactcaccatggatttcgggctgagtctgggttttccttgttgttatttacaaggtgtccagagtgaagtgcagttggtggagtccggggganacttggtccagcctggagggtccctgagactctcctgtgtcgcctctggattcaccatcagtgaccactanatggactgggtccgcccaggctccgaggggaaggggctgggagtggcttggccgacaagtaaaaacngtaagtcactgtcttanacacgagtacgcgcgcctgtagaaggacacgactacctacctaccctacacaaggagtatactaactaaacaactaacttactaggttactcgttacggtacagaaacggtactaaaccgtaacgaaaaccgaacggaaaccgacgggggttaccaacgttacggttaacgtttaactttagttagtttgggttttagttttaacgttacgttacgtacgtaacgtaacggttaccgg

SEQ ID NO: 439017 - DNA, 575 bp, Homo sapiens
  misc_feature: GZ8MTXP02FGXU4.44.36.D03.1.454.CMB.2.raw
  modified_base (280)..(280): a, c, t, g, unknown or other
  modified_base (310)..(310): a, c, t, g, unknown or other
  modified_base (347)..(347): a, c, t, g, unknown or other
  modified_base (360)..(360): a, c, t, g, unknown or other
  modified_base (368)..(368): a, c, t, g, unknown or other
  modified_base (418)..(418): a, c, t, g, unknown or other
  modified_base (461)..(461): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccgggggagacttggtccagcctggagggtccctgagctctcctgtcgtcgccctggacttcaccntcagtcgaccactatatggactgggtcccncaggctccgaggggaagggctggagtggctggccganaagtaaaacagtncagcttancacagagtaccgcgtcgtctgtagaaagtcccaagtacttccaccccttnaccgaaagacgatacgacttacaaagtaactcattgactttcngacgaatcgaacctaaactacgaaaaaccgaggaacacggggcaagttagttaatttagttcggtgttttagtggttttaatacgtacgtaacggtaactcggtaccgtacggg

SEQ ID NO: 439018 - DNA, 675 bp, Homo sapiens
  misc_feature: GZ8MTXP02FU3E7.44.36.D03.1.454.CMB.2.raw
  modified_base (220)..(220): a, c, t, g, unknown or other
  modified_base (272)..(272): a, c, t, g, unknown or other
  modified_base (537)..(537): a, c, t, g, unknown or other
  modified_base (575)..(575): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttgggtggaggtccggggganacgttgggtccaggccgtgggacgggtccctgagactctcctgtgtcgcctntggattcaccatcagtcgaccatatagtggactcgggtcccgccgaggcctaccggaaggggaacggggctggggaggtcgggtccgttggggcccgaacaaaggtaaaaaaccgaaaggttccgaccctagtccttttaagtcaaacgaggacgtaccgcccggtcgttactagggtaacgaaaacgccctaaagtaccttcccgaacccctctacgaaagtacgattacgaacttacaaaagtacctactatttagactttcnggaacctaaagtcgaaacctaaccgacggaaaaaccgngaacgacgggactattgtatttagttgttagtttgttacgtttaatacgttaacgaagtaacgttcggtcccgtaaggtccgggggtaacctaacggggg

SEQ ID NO: 439019 - DNA, 694 bp, Homo sapiens
  misc_feature: GZ8MTXP02JHAET.44.36.D03.1.454.CMB.2.raw
  modified_base (271)..(271): a, c, t, g, unknown or other
  modified_base (299)..(299): a, c, t, g, unknown or other
  modified_base (403)..(403): a, c, t, g, unknown or other
  modified_base (493)..(493): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttccttgttgttatttacaaggtgtccagagtgaagtgcagttggtggaggtccgggggagacgttggtccagccgtggacgggtccctgagactctctgtgtcgcctntggattcaccatcagtcgaccatatagnggactcgggtccgccgaggcctaccggaggggaaggggctagggagtggcgttcgggaccgacgaaaacgtaaaaacgtaagttcgacctaggttaccttttanccgaacaaggtacgtaacccggcccgtacgttcccgttaggtaaggaaaaccctcccgaagtactttacccaccccctttgaaccaaagngtaactgtaaaccttcgaaaagtaccctgtaagtttagtacttacgtagaacgtaagtacgtaaacccgtaaaccgaaaacgggaaaacccggacggtaaaccgggtacggacttaaggttaacgtttaactttacgttggtttaacgtttgtttaacgttttaagtaacgttacggaaacggttaccgtaccggttaccg

SEQ ID NO: 439020 - DNA, 771 bp, Homo sapiens
  misc_feature: GZ8MTXP02IMGO7.44.36.D03.1.454.CMB.2.raw
  modified_base (225)..(225): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccggggganacgttggtccagccgtgggacgggtccctgagactctcctgtcgtcgcctctggacttcaccatcagtcacctatatagtggacgtcgggcccgccgaggcctaccggaggggaacggggcgtagggaggtcggcgttcgggaccgtaacgaaaagtaaaaaacgtaagttcgacctagttactttacgacaacgacggtacgtaccgccggtacgttcgtacgtaaagaaaaccggtcccaagttaactttaccccgaaccccttacgtaaaccgaaaaggtaacggtacttaaccggtaacctttaaaccgaaaacggtaaacccgtttactaaagttttcggaaacttttccgacggtaacggttaaaacttacggtaaaacccttaaacccgtaaaacggaaaaaaccccgggtcgggtaaaacccgaacgggggtacttaaaaggtttacgtttaaaacgttttacgtttaggtttagtttaagggttttaaccttttaaagtacgttaacggaacggtttaaaccttcggttaaccccgg

SEQ ID NO: 439021 - DNA, 736 bp, Homo sapiens
  misc_feature: GZ8MTXP02JOICN.44.36.D03.1.454.CMB.2.raw
  modified_base (421)..(421): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgagtgcagttggtggaggtccggggagacttggtccagcctggagggtccctgagactctcctgtgtcgcctctggattcaccatcagtgaccactatatggactgggccgcaggctcgaggggagggctggagtggcttggccgacaagtaaaacaagttcgaccagtcttatcacagagtacgccgcgtcgtgtagaaaagcccaagtactttcccgacccttanaccgaaagtacgaattacggaacctttaccgaaaagtaaaccctttacaagtttacgggtaaacctttccgttaggaacccgtaaaatttaaccgggaaaaccctttaaaaccccgttaaaacgggaaaaaaacccccgggtaaacgggggaaaaccccaaacccggggggtaaaccttaaaacggtttacgggttttaaaacgttttaaaacggtttttgggtttaacggtttttgggggtttaaacgtttttttaacgtaaaaccgtttacgggtaaacggggttaaaaccgtttccggtttaaacccccggg

SEQ ID NO: 439022 - DNA, 598 bp, Homo sapiens
  misc_feature: GZ8MTXP02JLX97.44.36.D03.1.454.CMB.2.raw
  modified_base (466)..(466): a, c, t, g, unknown or other
  modified_base (510)..(510): a, c, t, g, unknown or other
  modified_base (574)..(574): a, c, t, g, unknown or other
tcagacagtatatacacgaccggtgctcgatttagctgcgtcacgatctctctcggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccaggccgtgggacgggtccctgacgactctccgtgtgtcgcctctggacttcacatcagtgaccactatagtggacgtgggtcccgcgaggccgtaccggaggggaacggggcgtgggaggttgggcgttcgggccgaccgtaaagtaaaaaacaaagttcgacctaagtcttttagcaacgtagacgttaccgccgtacgtctagtagaaacgccagactttccacccctntacgaagagactcgaacttacaaagtaactctattcgaatttcngagtaatcaactaacgaaagaaacccgagaccgtagggatgttagtatgtttagtgttaagttntttaactctagaacgtactcgacg

SEQ ID NO: 439023 - DNA, 590 bp, Homo sapiens
  misc_feature: GZ8MTXP02FID3J.44.36.D03.1.454.CMB.2.raw
  modified_base (375)..(375): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagctctcctgtgtcgcctctggattcaccatcagtgaccatatatggactgggtcccgcaggctccgaggggaggggctgggagtggcttggccgacaagtaaaaacaagttgccagtctttacanagagtaccgcgcgtctgtagaaacgccaagtacttcccacccccgtcttaccaaaggagaactcgtaacctttacaaaagtaaccttacaatttagatttcctaggaccgtaaatcgaacctaaaccgtagaaaaacccggaggtaaccgacggggactaagttgttaatttattggttagtttgttagtttaatatcgaaggtaactcgtaccg

SEQ ID NO: 439024 - DNA, 602 bp, Homo sapiens
  misc_feature: GZ8MTXP02F7F4W.44.36.D03.1.454.CMB.2.raw
  modified_base (271)..(271): a, c, t, g, unknown or other
  modified_base (310)..(310): a, c, t, g, unknown or other
  modified_base (381)..(381): a, c, t, g, unknown or other
  modified_base (485)..(485): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccgggggagacttggtccagccgtggacggtccctgagactctcctgtgtcgcctntggatcaccatcagtgaccactatagtggactcgggccncgaggctccggaggggacggggctgggagtggcttggccagaaagtaaaaacaagttcgaccagtctttancaacgagacgtaccgccgtcgttctagtagaaacgccctaagtacttacccaacccctctaacgaagagtatacgtacttacaaagtaactctattagattcgngacgtaatacgaaccgtaaacgtaacgaaaaccggtaggaaccgaagggactaagttagttaacttagttgttagttaagtttacgtttaatacgtactaacggtactcgtacccgg

SEQ ID NO: 439025 - DNA, 612 bp, Homo sapiens
  misc_feature: GZ8MTXP02H9XDU.44.36.D03.1.454.CMB.2.raw
  modified_base (367)..(367): a, c, t, g, unknown or other
  modified_base (553)..(553): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaaggccctggagtggcttgcacacatcttctcgaatgaacgaaaatcctaacagtacatctctgaagagactaagtttaaccatctaccaaaggaccacctaccaaaaggcaggtgtactttagtatgaaccaaacatcgaccctgcgacaccgagcacatattacngtgacgaacggtaagtaggaacgggaaaagaaacagtcgttaggttctagttaattaaataagttacttaacctaatcgtagggacgttcgtaggggacaaaacggggaccgtaacggtcaccggtctccgtacacgtccgttaccaaccgaacgggtccccaacgttccggtccctttcccccgngtcccgcccgtgcccgtccgacggcgtaccgacccgtcgcgggggacacgacggcccgg

SEQ ID NO: 439026 - DNA, 618 bp, Homo sapiens
  misc_feature: GZ8MTXP02FF6FF.44.36.D03.1.454.CMB.2.raw
  modified_base (222)..(222): a, c, t, g, unknown or other
  modified_base (331)..(331): a, c, t, g, unknown or other
  modified_base (380)..(380): a, c, t, g, unknown or other
  modified_base (433)..(433): a, c, t, g, unknown or other
  modified_base (444)..(444): a, c, t, g, unknown or other
  modified_base (466)..(466): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacgttggtccagcctggagggtcccctgagactctcctgtgtcgcctctggattcaccatcagtgaccatatatggactgggtccgccaggctccgaggggaaggggcngggagtggcttgggccgaccaaagtaaaaacaagttcgaccagctttancaacagagtacgccgcgtctgtagaaaacgcccaagtacttcccaaccccgtntacgaaaaganatcgtaaactacaaagtacctntaagtttagattccgaggaacgtaaagtacgaaaccttaaaacgaacgaaaaccggaaaacggacggtaaccggaacgtaagttaagttacgtttaagttagtttaggttaagtttagtttaagttactacgtaacggtaacgtacgtaccg

SEQ ID NO: 439027 - DNA, 669 bp, Homo sapiens
  misc_feature: GZ8MTXP02JUL36.44.36.D03.1.454.CMB.2.raw
  modified_base (274)..(274): a, c, t, g, unknown or other
  modified_base (278)..(278): a, c, t, g, unknown or other
  modified_base (291)..(291): a, c, t, g, unknown or other
  modified_base (315)..(315): a, c, t, g, unknown or other
  modified_base (382)..(382): a, c, t, g, unknown or other
  modified_base (632)..(632): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttgggtggaggtccgggggagacgttggtccaggcctgggacgggtccctgagactctcctgtgtcgcctntggnttcaccatcagtnaccatatagtggacgtcgggtccncaggctccggaggggagggctgggagtggtcgtggccgacaaagtaaaacagttcgccagtctttancaacagacgtaccgccgtacgtccgtagtacgaaacgcccagtacttcccgacccctctacgaaagagatacgtaacttacgaaacgtaactcgtaagtttacggtactttacgtagtacggtaaacttacggtaaaaccccttaaaccgtaaacgggaaaaaaccccggtacggggaaaacccgaaccgggggtacctaaagtttacggttaacttttaagttggtttaggtttaagtttaagttttanaacgtttacggaaggttaaaccgttcggtaaccccgg

SEQ ID NO: 439028 - DNA, 645 bp, Homo sapiens
  misc_feature: GZ8MTXP02JVZV4.44.36.D03.1.454.CMB.2.raw
  modified_base (274)..(274): a, c, t, g, unknown or other
  modified_base (402)..(402): a, c, t, g, unknown or other
  modified_base (563)..(563): a, c, t, g, unknown or other
  modified_base (621)..(621): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtgggaggtccgggggagacttgggtccagccgtgggacgggtccctgagactctcctgtgtcgcctntggattcaccatcagtcgaccactatatggactgggtcccgccgaggcctccggaaggggaaggggctgggaggtgggcgttcgggccgaccgaaagtaaaaaccgaaggtttcgaccaagtctttancaacagacgtaccgccgcgtctgtagaaacgcccaagtacttcccacccctctacgaaagagactagtaaccttacgaaaagtaacctctaagtttacgtaactttccgtaggaccgtaaattcggtaaaacccttaaaccggtaaacggaaaaacccggngggaaaccgacggggactaagttaggttaacttagtttggttgtttgttagttttaanacgtacgaacggtacttcgtaccg

SEQ ID NO: 439029 - DNA, 558 bp, Homo sapiens
  misc_feature: GZ8MTXP02FZYQJ.44.36.D03.1.454.CMB.2.raw
  modified_base (270)..(270): a, c, t, g, unknown or other
  modified_base (394)..(394): a, c, t, g, unknown or other
  modified_base (413)..(413): a, c, t, g, unknown or other
  modified_base (445)..(445): a, c, t, g, unknown or other
  modified_base (452)..(452): a, c, t, g, unknown or other
  modified_base (465)..(465): a, c, t, g, unknown or other
  modified_base (469)..(469): a, c, t, g, unknown or other
  modified_base (479)..(479): a, c, t, g, unknown or other
  modified_base (505)..(505): a, c, t, g, unknown or other
  modified_base (540)..(540): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgctagttggtggaggtccgggggagacttggtccagccgtggagggtccctgagctctcctgtgtcgctntggatcacatcagtcgaccactatgtggacgtgggtcccgccaggcctccggaaggggaacggggctgggagtggcttgggcccgacgaaagtaaaaaccaaggttcgaccctaagtcttttanccaacgagacgtacgccgngtctagtagaaacgccaagtcttccacccctnacaaagnatcgacttgaaanactnattgattcgngacgatgaacctaacgagaaaaccgngacgcggataagtgtattatgttagttgttattanactcgaagtactgtaccg

SEQ ID NO: 439030 - DNA, 579 bp, Homo sapiens
  misc_feature: GZ8MTXP02HOH2S.44.36.D03.1.454.CMB.2.raw
  modified_base (311)..(311): a, c, t, g, unknown or other
  modified_base (561)..(561): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttttccttgttgttattttacaaggtgtccagagtgaagtgcagttggtggaggtccgggggagacgttggtccagcctggagggtccctgagactctctgtgtcgcctctggattcaccatcagtcgaccactatatggactgggtccnccgaggctccgaggggagggctgggagtggcgtcgggccgacgaaagtaaaaacaaggtttcgaccgtagtacttttatcaacgagacgttaccgcccgcgttctgtagaaaacgcccaagtacttcccaaccctctacaaagacgtatcgaactttacaaagtacctctattagatttcagacaatcgaaactaacacgaaaacgagggacacgggctagtgttattagttgtagttgttagtttatancgtacggactttcgaccg

SEQ ID NO: 439031 - DNA, 608 bp, Homo sapiens
  misc_feature: GZ8MTXP02F661H.44.36.D03.1.454.CMB.2.raw
  modified_base (209)..(209): a, c, t, g, unknown or other
  modified_base (277)..(277): a, c, t, g, unknown or other
  modified_base (303)..(303): a, c, t, g, unknown or other
  modified_base (315)..(315): a, c, t, g, unknown or other
  modified_base (352)..(352): a, c, t, g, unknown or other
  modified_base (381)..(381): a, c, t, g, unknown or other
  modified_base (399)..(399): a, c, t, g, unknown or other
  modified_base (404)..(404): a, c, t, g, unknown or other
  modified_base (431)..(431): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcagttggnggaggtccgggggagacttggtccaggccgtgggagggtccctggacgctctcctgtgtccgcctcgnggattcaccatcagtcgaccatatgnggactgggtccncaggctcggaggggagggctgggagtggcttggccanaaagtaaaaacaagttcacgagtctttancaacagacgtcgcgcgtntgtanaaacgccaagtactttcccaacccctntacaaagagactacgtaaccttacgaaaacgtaaccttcgatttacggaattcccgtagacgtaaatacgtaacctaaacgtaacgaaaaaccggaggaccgaaggtctaagttaggttatttacgtgtttgttaagtttagtttaactaactacgtaaggtaaccttcgtaacccg

SEQ ID NO: 439032 - DNA, 730 bp, Homo sapiens
  misc_feature: GZ8MTXP02FW81A.44.36.D03.1.454.CMB.2.raw
  modified_base (411)..(411): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgctaggttggtgggaggtccgggggagtacgttggtccagccgtgggacgggtccctgagctctcctgtcgtcgctcgtggtattcaccatcagtcgaccactatagtggacgtcgggtcccgcgaggcctccggaaggggaaggggctggggagtcggcgttcgggaccgacgtaaaacgtaaaaaactaaggttcgacctagtctttanccaacgagacgtaccgcgtcgtctagtagaaacgcccaagtacttcccaccctctacgaaagagtatacgtaacttacgaaaagtaaccttactaatttacggtactttaccgtaggtaacggtaaaattaaccggtaaaacccgttaaaacccgtaaaacggggaaaaaaccccgggaacgggaaaacccggggtaaaccggggttaacgttaaaacgtttacggtttaacgttttaaaggtttcggttttaggtttaaggttttacgtttaaagttaacggttacgtaaaacggtaccgtttacgttaaccccgggg

SEQ ID NO: 439033 - DNA, 640 bp, Homo sapiens
  misc_feature: GZ8MTXP02JMOF5.44.36.D03.1.454.CMB.2.raw
  modified_base (305)..(305): a, c, t, g, unknown or other
  modified_base (388)..(388): a, c, t, g, unknown or other
  modified_base (429)..(429): a, c, t, g, unknown or other
  modified_base (450)..(450): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggaggtccctgagactctcctgtgtcgcctctggattcaccatcagtgacctactatagtggactcgggtccnccgaggcctccgaggggaaggggctgggagtgggcgttgggcccgcaaaggtaaaaaaactaaaggttcgacccagtctttancaacagagtaccgccgtcgtctagtagaaaacgcctaaagnttacccaccctctacaaaganatagtactacgaaataactatattagtactttcgagacgtaaatacgaaacctaaaccgtaaacggaaaaccggacggaaccgacgggtactaacgttagttaattacggttaggttagtttagttagtttaatacgtaacgtaacggtaaaccttcgtaaccgtacgggtaccggggaccgtaacgggg

SEQ ID NO: 439034 - DNA, 489 bp, Homo sapiens
  misc_feature: GZ8MTXP02ILOT0.44.36.D03.1.454.CMB.2.raw
  modified_base (361)..(361): a, c, t, g, unknown or other
  modified_base (380)..(380): a, c, t, g, unknown or other
  modified_base (474)..(489): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggtccgttttatttctgtgcgaggcgagactggtctttcaatctagtgggcctggcacctggtcactgtctcctcacgtctccaccgaacgggccccagtccggtccttcccccgtggccgccctgcctccgaggacncaccgtcgtcggggcacgnggccggcccgtgggctcggccgtggtccaaggtaccttacttccttagtacttacgtgtctagaggcgggtcgtgggacgaaggcgacagtagnnnnnnnnnnnnnnnn

SEQ ID NO: 439035 - DNA, 604 bp, Homo sapiens
  misc_feature: GZ8MTXP02HKZXF.44.36.D03.1.454.CMB.2.raw
  modified_base (317)..(317): a, c, t, g, unknown or other
  modified_base (459)..(459): a, c, t, g, unknown or other
  modified_base (496)..(496): a, c, t, g, unknown or other
  modified_base (541)..(541): a, c, t, g, unknown or other
  modified_base (578)..(578): a, c, t, g, unknown or other
  modified_base (587)..(587): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctagttggtgggagtccgggggagacttggtccagcctgggagggtccctgagactctcctgtgtcgcctctggattcaccatcagtcgaacctactatatggacgtgggtcccnccgaggcctccgaggggacgggctgggagtcggcttgggcccgacgaaagtaaaaaacctaaggttgaccctaagttactttatccaagagacgtaccgccgtacgttctagtagaaacgccaagtactttccgaacccctntacaaagtacgatacgtaaccttcaaaagtacccttnaatttgattccgtgaacgtatgaaacctaaacgtacgaaaaccgngaccgaggactaattgtaattgttagttgttaagttnttaattacngtaacgtactcgtaccg

SEQ ID NO: 439036 - DNA, 698 bp, Homo sapiens
  misc_feature: GZ8MTXP02G75NF.44.36.D03.1.454.CMB.2.raw
  modified_base (285)..(285): a, c, t, g, unknown or other
  modified_base (320)..(320): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcgaggttggtggaggtccgggggatacgttgggtccagccgtggaggtcctgagctctctgtgtcgcctctggactcacctntcagtcgacctactatagtggaccgtcgggtcccnccgaggcctaccggaagggggaacggggtcgtagggaggttcgggtccgttcggggaccgtaaccgtaaaagtaaaaaaaccgtaaaggtttccgacccgtaagttacttttacgacaacgtaaggacgttacccggccggtcgtccgtagtaaacgaaaacggtcccaaaggtactttacccgacccctctaacgaaaagtacgtacttaacgtaacctttacgaaaacggtaacttccgtaatttaggtaacttccgttagaacgtaatcgaaacctaaccgaagaaaactacgggacacggactagttaagttacgtttagtggtttacgtttaagttagtttataacgtcggtaaaacggtacttcggtaaccg

SEQ ID NO: 439037 - DNA, 585 bp, Homo sapiens
  misc_feature: GZ8MTXP02JIEZF.44.36.D03.1.454.CMB.2.raw
  modified_base (342)..(342): a, c, t, g, unknown or other
  modified_base (357)..(357): a, c, t, g, unknown or other
  modified_base (365)..(365): a, c, t, g, unknown or other
  modified_base (380)..(380): a, c, t, g, unknown or other
  modified_base (385)..(385): a, c, t, g, unknown or other
  modified_base (391)..(391): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggagacttggtccagcctgggagggtccctgagactctcctgtgtcgcctctggattcaccatcagtgaccactatatggactgggtcccgcaggctccgaggggagggctggagtggctggcncaagtaaaacaagtncagtcttncacagagtacgccgntctgngaaacnccaagacttccaccctctacgaagacgatcgacttacaaagtaactctaattgaatttctggaccaaagttcgaaaccttaacccgtaggaaaaacccggcggaaccgacgggactagttaacgttactttagtttggtttacgtttaaggtttagttttaacgtacgtacgtacggttaaccgtcggtacccg

SEQ ID NO: 439038 - DNA, 604 bp, Homo sapiens
  misc_feature: GZ8MTXP02GX0GX.44.36.D03.1.454.CMB.2.raw
  modified_base (280)..(280): a, c, t, g, unknown or other
  modified_base (325)..(325): a, c, t, g, unknown or other
  modified_base (409)..(409): a, c, t, g, unknown or other
  modified_base (513)..(513): a, c, t, g, unknown or other
  modified_base (553)..(553): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggtgggaggtccgggggatacgttggtccaggtccgtgggacgggtccctgacgtactctccgtgtgtcgcctntggtacttcaccatcagtcgacctatatatggacgtcggggtccncgaggcctacggaggggacgggctgggaggtggtcgttcgggaccgacgtaaacgtaaaaacaggttcgacctagttactttanaccaagaggacgtaccgccgtcgtacgtagtagaaacgccgtagtacttacccaccccttgtacaaagtagatacgtaacttacaaagtactcgtattgacttnacgatagtcaacctaacgaagaaaccggagacggcggtanagttagtattacgttgtgttaagttattaatcacgtacgacttacggtccg

SEQ ID NO: 439039 - DNA, 582 bp, Homo sapiens
  misc_feature: GZ8MTXP02GSC8F.44.36.D03.1.454.CMB.2.raw
  modified_base (314)..(314): a, c, t, g, unknown or other
  modified_base (380)..(380): a, c, t, g, unknown or other
  modified_base (427)..(427): a, c, t, g, unknown or other
  modified_base (506)..(506): a, c, t, g, unknown or other
  modified_base (563)..(563): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtgggacgggtccctgagactctcctgtgtcgcctctggattcaccatcagtcgaccatatagtggactgggtccncgaggctcgagggagggctgggagtggctgggccagaaagtaaaaacaagttcgaccagtctttancaagagacgtaccgccgcgtctagagaaacgccagacttccaccctntacaaagagactgaacttacaaagtactcattgaattcgagacgtaattacgaaaccttaaaccgtaagaaaaacccgnggaaccgagggactaagtacggttattagtttggttagttgttacgtttatacgtanaacggtaactcgtaacccg

SEQ ID NO: 439040 - DNA, 660 bp, Homo sapiens
  misc_feature: GZ8MTXP02I8GB6.44.36.D03.1.454.CMB.2.raw
  modified_base (329)..(329): a, c, t, g, unknown or other
  modified_base (404)..(404): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtgggaggtccgggggagtacgtttgggtccaggccgtgggacgggtccctggacgactctcctgtgtcgccttctggacttcaccatcagtcgaccactatagtggactcgggtccnccaggctccggaggggaacgggctgggagtggcttgggcccagaaagtaaaaaccaagttcgacctagtctttancaacgagtacgaccgcgcgttactgtagaaacgcccgaagtaccttcccacccttcacaaagagactgaaacctttaacgaaagtaaccttctaagtttggtaaactttcgaggtaaccgtaaatacggaaacccttaaaaccgacgaaaaaacccgggtaggaacctaaaccggggctaaaagttggtttaaatttagtttggttagttttgtagttttaaatacttacggtaaggtaaccttcggttaacccgg

SEQ ID NO: 439041 - DNA, 645 bp, Homo sapiens
  misc_feature: GZ8MTXP02FTJPA.44.36.D03.1.454.CMB.2.raw
  modified_base (398)..(398): a, c, t, g, unknown or other
  modified_base (456)..(456): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcaggttgggtgggaggtccgggggagtacgttggtccagccgtgggacggtccctgacgctctcctgtgtcgcctctggattcaccatcagtcgacctatatagtggacgtcggggtcccgccgaggcctccggaggggaggggctgggagtggcgttggccgacaaacgtaaaaacagttcgaccagtctttanccacgagacgtcgccgtcgtctgtagaaacgccagtacttcccaccctctacgaaagngaaactcgtaaaccttacaaaagtacctactagtttgaatttccaggtacgtaaacgttacggaaacccttaaaaccgtaacgaaaaacccgggacggtaccgaaacggggtctaaagttgtttaaactttagttggtttagtttaacggtttatttaagtacgtacgaaggttacctacggtaaccgg

SEQ ID NO: 439042 - DNA, 725 bp, Homo sapiens
  misc_feature: GZ8MTXP02HUXS8.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttcttgttgttatttacaaggtgtcagagtgaagtgcgagttgggtggaggtccgggggagtacgttggtccaggccgtgggacggggtccctggacgtacctctccgtgtcgtcgcctcgtgattccaccatcagtcgaacctatatagtggacgtcgggtcccgccgaggcctaccggaggggaggggcgtggaggtcggtccgttgggccgaacgtaaaagtaaaaaacgtaagttcggcctaagttactttacgactaaacgaagaccgttaccggcccgtacggttcgtacgtaagaaaacgcccgtaagtacttacccctacccttcctaacgaaacgtagtatacgtacctttaacgaaaacgttactttaccgaattttagtacttacgtggtaaccgtaaagtacgtaaaccctaaacggttaaaacgaaaaacccggcggaaaacccgtggggaaaccttagttaggtttaacgttttaacgtttgggttagttttaacggtttaattttaaacgttacgtaaccgtaaggtaaacctttcgggtaaccccgg

SEQ ID NO: 439043 - DNA, 678 bp, Homo sapiens
  misc_feature: GZ8MTXP02JNGJY.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccaggcctgggacgggtccctgagactctctgtgtcgcctctggacttcacatcagtgaccactatatggactcgggtccgcgaggctccggaggggacggggctgggagtcggacgttcggaccgtaccgtaaagtaaaaaaccgaagttcgaccctagtctttacgtcaacgaggtacgtaccgccggtcgtctgtagaaacgcccaagtacttcccgacccttctacgaaacgagtatcgtaacttacaaaacggtaacttacgtaatttcggaactttaccgtaggtaaccgtaaattaccggtaaaccttaaaacccgtaaacgggaaaaacccggacggggaaaccgtacggggaacctaaggtttacggttaaactttacgtttggttagttttgttagttttaaatacgtaccgtaaggtaacgttcgtaacccgg

SEQ ID NO: 439044 - DNA, 671 bp, Homo sapiens
  misc_feature: GZ8MTXP02HVPAP.44.36.D03.1.454.CMB.2.raw
  modified_base (322)..(322): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggttgtcagagtgaagtgcagttggtggagtccgggggatacttggtccagccgtggacgggtccctggagacttctccgtgtgtccgccttcgtggacttcaccatcagtcgaccatatagtggacgttcgggtccnccgaggcgtaccgaggggaaggggcgtaggaggtcggtcggttcggaccgtaacgaaagtaaaaaaccgaaagttcgactacgttactttactcgaacaacggaacgttaccgcccgtcgttcgtagtagaaaacggccagacttcccacccgttctaacgaaggatatcggtaaactttccgaaaagtaaccttactagtttagtactttacgtacgaacgtaagtaacgtaaacccctaaacgtaacggaaaaacccggtggaaacccgaggggtacctaagttagttacttagtttagttgttaagtttagtttaataacgtcgaacgggtaacttcggtacccgg

SEQ ID NO: 439045 - DNA, 655 bp, Homo sapiens
  misc_feature: GZ8MTXP02HEBER.44.36.D03.1.454.CMB.2.raw
  modified_base (209)..(209): a, c, t, g, unknown or other
  modified_base (308)..(308): a, c, t, g, unknown or other
  modified_base (372)..(372): a, c, t, g, unknown or other
  modified_base (376)..(376): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttggnggaggtccgggggagacttggtccagcctggagggtccctgagctctctgtgtcgcctctggattcaccatcagtcgaccactatatggactgggtccnccaggctccgaggggagggctggagtggctggcgacaagtaaaacaggttgacctagtctttancaanagagtccgcgcgtctgagaaagccagtattcccaccctctacgaaagagactgaacttacgaaagtaaccttctaatttcggtaaactttcgtacgaaccgggttaaataccggtaaaccttaaaaccccgtaagggaaaaaaaacccccgggtcgggaaaaccggaaaccgggggaccttaaggttaccggttttaaagtttaacgttttaggttgtttaaccgggtttattttaaagtacgttacggtaacggggttaaactttcgtttaacccggg

SEQ ID NO: 439046 - DNA, 697 bp, Homo sapiens
  misc_feature: GZ8MTXP02JJX7E.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcgttgggtacgagggcgggggggtccctggagactctcctgtgcagcctctggattcatctcagtgactatcgcctagtagaacgtcggtcccgccgaggcctccggaggggaacggggcgtgggtaggttcgggtttaccaagttagttagtttaaattagtttggtcgtgggacgtaacttaaccccgtaacccttacgtaaccgacgtaaacgtaccttacgttaggtagggaaaccggggtccctaatttacccgaaaccctaagttacccgaagggtaaccaagttacggaaccctaaacgaaccttaccaacgttaggtaacttacgtaagggaaaacttacggaaaccaacggtaccgtagggaacgaacgggaacggaacggaaccgtacgggtaccttcggttacccttacgtttacgtcgggttaaccgaggtacgtacggtaccgggttaccgttaccggttgg

SEQ ID NO: 439047 - DNA, 601 bp, Homo sapiens
  misc_feature: GZ8MTXP02FNWHW.44.36.D03.1.454.CMB.2.raw
  modified_base (278)..(278): a, c, t, g, unknown or other
  modified_base (281)..(281): a, c, t, g, unknown or other
  modified_base (408)..(408): a, c, t, g, unknown or other
  modified_base (469)..(469): a, c, t, g, unknown or other
  modified_base (507)..(507): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtggaggtccgggggagtacgttgggtcccaggccgtgggacgggtccctgagactctcctgtgtcgcctntgntcacatcagtcgaccactatagtggacgtcgggtcccgccgaggcctccggaaggggaacggggctggggaggtcgggcgttggggcccgacgtaaaagtaaaaaacgagttcgacctagtctttanccaacgaggtacgtaccgccgtcgtcgtagtacgaaacgcccaagtacttcccgacccctntacaaagagactcgaaccttacaaagtactctaatttnattcagacgtaatcgaaacctaacgtacgaaaaccgcgacgacggctatagttattagtgttagttgttagtttacacgtagaggactgtaccg

SEQ ID NO: 439048 - DNA, 737 bp, Homo sapiens
  misc_feature: GZ8MTXP02I1J1C.44.36.D03.1.454.CMB.2.raw
  modified_base (280)..(280): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcagttggtggaggtccgggggagtacgttggtccaggccgtgggacgggtccctgacgactctcctgtgtcgcctgtgntcacatcagtcgaccatatagtggacgtcgggtcccgaccgacggccgtaccggaagggggaacggggtcgtggggtagttggggtccgttacggggcccgtaaccgtaaaagtaaaaaaaccgtaaaggtttacggaccctaaggttacctttttacgaccaaacgaaggtaaccggtacccgcccgtacggtccgttagggtaacgaaaaccgcccgtaaagtactttaaccccgacccccttcgtaaccgaaaaggacgtaactacgtaaaccttacgaaaacgtaacttacgtattacggtaactttctacgggaactaattaaccggtaaaccttaaacccgtaaaaggaaaaaccccggaggaacgtaaacgggactaagttagttaactttaggttggttagtttaacgttagtttaataacgttcgtaaacggtaacttcggtaacccg

SEQ ID NO: 439049 - DNA, 701 bp, Homo sapiens
  misc_feature: GZ8MTXP02HQ85M.44.36.D03.1.454.CMB.2.raw
  modified_base (518)..(518): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttatttactaggtgtccagagtgaagtgctagttggtgggagggtccgggggtaggacgttggtccaggccgtgggacgggtccctgagtactctcctgtgtcgcctctggtcttcaccatcagtcgaccctaactactaagtggtaccgtcgggtcccgcgacggctccgaggggaaggggcgtgggaggtggtcgtggccgacgaaagtaaaaacgagttacggaccagttactttagtcacagtacgtacggccgtcgtcgtgtacgaaaacgtccgaagtactttccctacccctctacaaacggagttacacgttacgtttacccgaaataaaacccgttnttaagttagtacgttacgtacggtacgtaaacgtaacgtaaaacccgttaaaacccgtaaaacggaaaaaccgggtaacggaaacccggtacgggtactaaagtttaagtttaacgttagttttaggtttggtttaagtttacgtttaaatacgtacggtaaacggttacgttaccggtaccg

SEQ ID NO: 439050 - DNA, 602 bp, Homo sapiens
  misc_feature: GZ8MTXP02IPIDT.44.36.D03.1.454.CMB.2.raw
  modified_base (279)..(279): a, c, t, g, unknown or other
  modified_base (289)..(289): a, c, t, g, unknown or other
  modified_base (411)..(411): a, c, t, g, unknown or other
  modified_base (496)..(496): a, c, t, g, unknown or other
  modified_base (541)..(541): a, c, t, g, unknown or other
  modified_base (581)..(581): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccaggccgtgggacgggtccctggagactctcctgtgtcgcctntgattcaccntcagtcgaccactatagtggacgtcgggtcccgccgaggcctaccggaaggggaacggggtctggggaggtgggccgttcgggaccgacaaagtaaaaacgtaagttcgacctagtctttancaacagacgtaccgcgcgtctagtagaaacgccaagtacttcccaccctctaacaaggatatgtaaaccttacgaaaagtacctntagttgaacttcgagacgtaatacgaacctaaacgagaaaaccgnggacacggctaagtgttatttagttgttgttgttagttanagtacgaacgtactgtacccg

SEQ ID NO: 439051 - DNA, 714 bp, Homo sapiens
  misc_feature: GZ8MTXP02JBRZS.44.36.D03.1.454.CMB.2.raw
  modified_base (375)..(375): a, c, t, g, unknown or other
  modified_base (379)..(379): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccgccaggctccgaggggagggctggagtggcttgggccaccaagtaaaaacaagttcgccagctttancaanagagtacgccgcgtctgtagaaagcccagtacttccaccctctacgaaagacgagtacgtaaactttccgaaaagtaaccttactaagttttcggaaactttcccgttaggaccgtaaaagttcggtaaaacccctttaaaaccccgtaagggaaaaaaaacccccgggtagggaaaacccgaaacccggggggtaactttaaaggtttacgggttttaaaacttttaacggtttttgggtttaaccgggtttttaagggttttaaacggtttttaaaaccctttaaggtacccgttaaaagggggtaaaccctttttacggtaaccccccgggg

SEQ ID NO: 439052 - DNA, 696 bp, Homo sapiens
  misc_feature: GZ8MTXP02HO4W4.44.36.D03.1.454.CMB.2.raw
  modified_base (439)..(439): a, c, t, g, unknown or other
tcagacagtatatacacgaccggtgctcgatttagctgcgtcacgatctctcttggggagctctgagagcggagccccagccccagaattcccaggttgttttcatttggtgatcagcactgaacacagaggactcaccatggagttcgggctgagcttgggttttccttgtttgttattttacaaggtgtccagagtgaagtgcgtaggttgggtgggaggtccgggggagtacgttgggtccaggccgtggggacgggtccctgacgtacctctccgtgtcgtccgcctctggacttcaccatcagtcacctactatagtcggacgtcgggtcccgccgaggccgtaccggaagggggaaggggtcgtaggggtaggtgggtcgttcggggacccgaccgtaaaagtaaaaaacaaggttcgacctagttctttacncaacgtagacgtaccgccgcgtctagtacgaaacgccaaagtaccttacccgaaccccttcgtaacgaaacggtagtactacgtaaaccctttaacgaaaacgttaaaccttcttaagtttacgtaactttaccgagtaacgtaaagtaccgtaaaaccttaaacccgtaaaaggaaaacccggaggaaccgacgggtactagttagttaactttgttgttgtttgttagtttatacgtacgacgtacttcgtaccg

SEQ ID NO: 439053 - DNA, 650 bp, Homo sapiens
  misc_feature: GZ8MTXP02FRXXR.44.36.D03.1.454.CMB.2.raw
  modified_base (609)..(609): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccgagggaacggccctggagtggcttgcacacatcttctcgaatgaacgaaaatcctaacagtacatctactagaagagctaacgtttaaccatcctaccaaggaccacctaccaaaaggcaggtggttactttagtatcgaccaacacgtacggacccctggaccggacaccgacggacaacattattaacgtgtgaccgtaacggggtaaagtacggaacggggaaaagaaacgaggtccgttggtttactagttaaatttaagttaacgttaccttacctaagttcgtagggtaccgttcgggtacggggaaccgaaaacggggtacccgtaccgggttacctaacccggttcctcccgtacacgtcccttaccgaaccgaacggccctacgttccgtcccttccccgcgccncccgtcgccctcgagcgccacgtcggcgggcacgcgcccgg

SEQ ID NO: 439054 - DNA, 661 bp, Homo sapiens
  misc_feature: GZ8MTXP02I004F.44.36.D03.1.454.CMB.2.raw
  modified_base (276)..(276): a, c, t, g, unknown or other
  modified_base (280)..(280): a, c, t, g, unknown or other
  modified_base (317)..(317): a, c, t, g, unknown or other
  modified_base (520)..(520): a, c, t, g, unknown or other
  modified_base (578)..(578): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggatacgttggtccagccgtggagggtccctgagactctcctgtgtcgcctntggnttcaccatcagtgaccactatagtggactgggtcccnccgaggcctaccggaggggaacgggcgtgggagtcgggtctggggcccacgaaaagtaaaaaaccgaaggttacgacctaagttctttacgaccaactaggacgttaccgcccgtcgtaccttaggacgaaacgccctaagtactttacccaccccgttctaacgaaagacgtactagaaaccctttacaaaacgtaaacctntaagtttcgaaactttcaggtacaagttacgaaaccttaaaccgaacgaaaaaccggnggaaccgtaacggggctaagttagttattagttaggttgtttaagttagtttaactataacgtacggtaacttacgtaaccgg

SEQ ID NO: 439055 - DNA, 537 bp, Homo sapiens
  misc_feature: GZ8MTXP02FEQNS.44.36.D03.1.454.CMB.2.raw
  modified_base (328)..(328): a, c, t, g, unknown or other
  modified_base (360)..(360): a, c, t, g, unknown or other
  modified_base (383)..(383): a, c, t, g, unknown or other
  modified_base (388)..(388): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggtttctctctcaacgatattagaatgggtgtgagctggatccgtcagcccccagggaaggccctggagtggcttgcacacatcttctcgaatgacgaaaaatcctacagtacatctctgaagagcagtttaaaccatctccaaggacacctaccaaaaaggcaggtggtctttagtatgaccaaanatggacccctgcggacaccaggcacatatacngtgcacgggtaatgacggaaaanaaacngctgtttctgtattataagtctaccatctgacgtcgtgggacaaagggaccacggtcaccgtctcctcagcttccaccaacgggccatcgtcttccccctcggccgccctcgctccacggaacgcacctcgcgggggcacgacgcccgg

SEQ ID NO: 439056 - DNA, 628 bp, Homo sapiens
  misc_feature: GZ8MTXP02FY1DP.44.36.D03.1.454.CMB.2.raw
  modified_base (312)..(312): a, c, t, g, unknown or other
  modified_base (407)..(407): a, c, t, g, unknown or other
  modified_base (444)..(444): a, c, t, g, unknown or other
  modified_base (465)..(465): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgtttattttacaaggtgtccagagtgaagtgctaggttgggtgggagggtccgggggagtacgttggtccgaggccgtgggacgggtccctgacgtctctcctgtcgtcgcctgtgtatcaccatcagtcgacctatanagtggacgtcgggtccgccaggccgtacggaggggaagggcgtgggtagtggcgttggtacgacaaagtaaaaacaagttcgaccaagtctttancacgtagacgtaccgccgtcgtacgtgtaacgaaacncctaagtacttccaacccctntaacgaagtactaatcgtaaacttacaaacgtactctattagtacttcgtacgagtaactagaacctaaacgtaacgaaaaccggtacggaacacgggtactagtttacgtattttagtgtttagttaagtttagttattacgactaacggacttcgtaaccg

SEQ ID NO: 439057 - DNA, 623 bp, Homo sapiens
  misc_feature: GZ8MTXP02F65U0.44.36.D03.1.454.CMB.2.raw
  modified_base (325)..(325): a, c, t, g, unknown or other
  modified_base (356)..(356): a, c, t, g, unknown or other
  modified_base (562)..(562): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctaccaaggacacctaccaaaaggcaggtggtctttagtatgaccaanatggaccctgcgacaccagcacatatactgngacgacgggtaatcggaacggaaaagaaacgacgtacgttggtttactagttaatttaataagttacttaacctattcgttagggacgttcggtagggggaacgaaaacggggacccgtaacggtacccgtacccggttcctacccgtacgaacgtccttaacccgaccgaacgggcccctaacgttcccgttacccttcccccgnggccccgtcccgtcgcctaccgaggtcgcccaccgtcgggacgggccaacgcggtccccgg

SEQ ID NO: 439058 - DNA, 642 bp, Homo sapiens
  misc_feature: GZ8MTXP02ICG74.44.36.D03.1.454.CMB.2.raw
  modified_base (270)..(270): a, c, t, g, unknown or other
  modified_base (309)..(309): a, c, t, g, unknown or other
  modified_base (382)..(382): a, c, t, g, unknown or other
  modified_base (402)..(402): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagcttgggttttccttgttgttattttacaaggtgtccagagtgaagtgcagttggtggaggtccgggggagacttggtccagcctggagggtcctgagactctcctgtgtcgcctcnggattcaccatcagtcaccactatatggacgtgggtccnccaggctccggaggggaggggctgggagtggcgttggccgacaaagtaaaaacaagttcgacctagtctttanctaacagtacgtaccgccgnttccaggtagaaacgcctaagtacttccacccttctacaaagacgtatacgtaacgtttacaaacggtaaccttatatttacgaacttttcgacgtacggaaacttacgaaaacccttaaacccgtaaagggaaaaaccccggtagggaaaacccgaccgggggtactaaaggtagtttaacttagtttgttagtttcggttatttaatagtacgtacgggtaaacctttcgtaacccgg

SEQ ID NO: 439059 - DNA, 661 bp, Homo sapiens
  misc_feature: GZ8MTXP02FK9VO.44.36.D03.1.454.CMB.2.raw
  modified_base (213)..(213): a, c, t, g, unknown or other
  modified_base (320)..(320): a, c, t, g, unknown or other
  modified_base (347)..(347): a, c, t, g, unknown or other
  modified_base (410)..(410): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttcctgttagttattttacaaggtgtccagagtgaagtgctaggttggngggaggtccgggggatacgttggtccagccgtggacggtccctgagcttctcctgtcgtcgcctgtgactcaccatcagtcgaccatatagtcggacgtcgggcccncgtaggccgtcggaaggggagggtcgnggggtagtgggcttcgggccgaacgtaaaacgtaaaaaccaggttcgaccctagttactttanaccgaagacggtacgtaccgccggtacgttacgtagaagtaaaccgcccgaatacttacccacccccttagaacgaaaggtataacgttcgaaacctttacgaaaactacttactaagttagtatttaccgaggtaactaaaggttacccaaacgtaaccgtaaacggaaaacccgaggtacggacgtacgtaagttagttagttacgttgtagtttgtagttatagttacgacgttaaccgtgtacccgg

SEQ ID NO: 439060 - DNA, 667 bp, Homo sapiens
  misc_feature: GZ8MTXP02F57B4.44.36.D03.1.454.CMB.2.raw
  modified_base (304)..(304): a, c, t, g, unknown or other
  modified_base (342)..(342): a, c, t, g, unknown or other
  modified_base (369)..(369): a, c, t, g, unknown or other
  modified_base (534)..(534): a, c, t, g, unknown or other
tcagacagtatatacacgaccggtgctcgatttagctgcgtcacgatctctcttggggggagagcggagccccagccccagaattcccagggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccncaggctccgaggggagggctgggagtggcttggccganaagtaaaaacagttcgaccagctttancacgagacgtaccgccgtacgtctgtagaaacgcccaagacttcccaccctctacgaaagtagattacgacttacgaaaacgtaactacctaagttacgtaactttcgtacgaccgtaaaagttaccggaaaccctttaaaacccgaaggaaaaaaaccccgggngggaaacccgaacgggggtacctaaagtttaggttaatttaagtttggttaggtttacgtttagtttaacttagtaaccggtaaaggaaacctttcggtacccacgggttacgggggaccctaaaaccggggg

SEQ ID NO: 439061 - DNA, 647 bp, Homo sapiens
  misc_feature: GZ8MTXP02FO710.44.36.D03.1.454.CMB.2.raw
  modified_base (395)..(395): a, c, t, g, unknown or other
  modified_base (486)..(486): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaggtgtccagagtgaagtgcaggttggtgggaggtccgggggagtacgttgggtccagccgtgggacgggtccctgagactctcctgtgtcgcctctggattcaccatcagtcgaccactatagtggactgggtcccgccaggcctaccggaggggaaggggctgggaggtggcgttggaccgacaaagtaaaaacaagttcgacagtctttancacagacgtaccgccgcgtctagtagaaacgccaagtactttcccaacccctctaacaaagtagactacgtaacttacgaaacgtaacctntaagtttagtaatttccgtaggtactaaacgttacggaaaccctaaaaccgtaacgggaaaaaacccggtcgggaaacgtaacggggacttaaagttaggttacttttaagttgtttagtttgttagtttaactagtacgtaacggtaacttcggtacccg

SEQ ID NO: 439062 - DNA, 626 bp, Homo sapiens
  misc_feature: GZ8MTXP02FSRC6.44.36.D03.1.454.CMB.2.raw
  modified_base (221)..(221): a, c, t, g, unknown or other
  modified_base (272)..(272): a, c, t, g, unknown or other
  modified_base (289)..(289): a, c, t, g, unknown or other
  modified_base (311)..(311): a, c, t, g, unknown or other
  modified_base (341)..(341): a, c, t, g, unknown or other
  modified_base (378)..(378): a, c, t, g, unknown or other
  modified_base (381)..(381): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttcctgttgttatttacaaggtgtccagagtgaagtgcaggttggtggagtccggggganacttgggtccagcctgggagggtccctggacgactctcctgtgtcgcctcnggattcaccatcaggtnaccactatatggactgggtccncaggctccgagggaaggggctgggagtggnttggccacaaggtaaaacaagttgaccaagctttacncanagacgtacgcgacgtctagagaaacgcaagtacttccacctctacgaagtacgatacgtaaccgttacaaagtaacctagtacgttagtacttcgagtacgtaaacgtacggaaaccttaaaaccgtaacggaaaaaccggacggaacgaaccggggtactaacgttacgtttaaacgtttacgttaggtttagtttaaggtttagttttaacgtacgttacggtaaacggtaactcggtacccg

SEQ ID NO: 439063 - DNA, 530 bp, Homo sapiens
  misc_feature: GZ8MTXP02HH1Z5.44.36.D03.1.454.CMB.2.raw
  modified_base (296)..(296): a, c, t, g, unknown or other
tcagacagtatatacacgaccggtgctcgatttagctgcgtcacgatctctcttggggacccagcttctgatgactctcctgttgccagcgtccatggcctcagtgaaggtctcctgcaaagctctggatacaccttcgccagctacgacattcactgtgtgtgacaggcccctggataaggtttgaatggatggtagggagctactctggcaatggtaacacaggctatgcacagaagttcagggcagagtcaccatgaccagggacacgtccacgagcacagcctaacatggancgtgagcagtcagagatctgaggacagtagaatgtgtactctagtgcgagaccgggtagaggacaaagacaaagaaaagaagtttcttagacgtacgtggggaccagggaaccctggtcaccgtctctacacgccctcaaccgacggccctagtccggtcccttccccgtcggcccaccctcctacccaacgacgaccacgtccggacggggcacggcgccggccgtcgggccg

SEQ ID NO: 439064 - DNA, 696 bp, Homo sapiens
  misc_feature: GZ8MTXP02GWW7V.44.36.D03.1.454.CMB.2.raw
  modified_base (344)..(344): a, c, t, g, unknown or other
  modified_base (511)..(511): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaaggtgtccagagtgaagtgcgtaggttgggtgggagggtccgggggagtacgttcgggtccaggtcccgtgggacgggttccctggacgtctcctcctgtcgtccgcctgtggacttccaccatcagtcgacctactatagtcggacgtcggggtcccncgaggcctaccggaggggaacggggcgttaggggaggtcgggccgttacgggaccgaacgtaaaacgtaaaaaacgtaacggttcgaaccctaggttacctttagaccaaacgaggacgtaccggcccgtcgtcgtagtagaaacgcccgaagtactcccacccttnaacgaagtagactacgtaccttacaaagtacttactagttactatcctaggaccgtaaatacggaaaccttaaaccgaaacggaaaacccgagggaaaccgacgggacttaagttacggtttaatttacgtttgttacgtttaaggtttaacttagtacgtagtaaacgtaccgtttcgacccgg

SEQ ID NO: 439065 - DNA, 613 bp, Homo sapiens
  misc_feature: GZ8MTXP02GYKEO.44.36.D03.1.454.CMB.2.raw
  modified_base (223)..(223): a, c, t, g, unknown or other
  modified_base (387)..(387): a, c, t, g, unknown or other
  modified_base (391)..(391): a, c, t, g, unknown or other
  modified_base (403)..(403): a, c, t, g, unknown or other
  modified_base (445)..(445): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccggggganacgttggtccagccgtggagggtccctgagactctccgtgtcgtcgcctctggatcaccatcagtgaccactatatggactcgggtccgccaggcctccgaagggtaagggctggggagtgggcgtggccgacaagtaaaaaccaagttcgacctagtctttancaanagagtacgccgngtctgacgaaacgccaagtacttccaaaccctcacaaaaggntactacgtaacctacgaaactactagtattgattcgacgaacgtaaacgtacgaaacctaaaccgtaaacggaaaaccggacggaaccgacgggacttaagttacgttaactttagtttgttacgtttgttacgtttaactacgttacgaacgtaactcggtaacccg

SEQ ID NO: 439066 - DNA, 564 bp, Homo sapiens
  misc_feature: GZ8MTXP02GUYGF.44.36.D03.1.454.CMB.2.raw
  modified_base (376)..(376): a, c, t, g, unknown or other
  modified_base (500)..(500): a, c, t, g, unknown or other
  modified_base (535)..(535): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccgcaggctccgaggggaaggggctgggagtgggcttgggccgacgaagtaaaaaacaagttgacccagtctttancacagagtacgccgcgtctgtacgaaagcccaagtacttccaccctcgtacaaagagatgaacctttacaaagaactcaatttgatttcctggtacaaatgaacctaaacctagaaaaacccgnggacacggggcatgtattaattgtattgtctttanatcaggaactgccacgtcggggcaacggg

SEQ ID NO: 439067 - DNA, 664 bp, Homo sapiens
  misc_feature: GZ8MTXP02FTMQC.44.36.D03.1.454.CMB.2.raw
  modified_base (418)..(418): a, c, t, g, unknown or other
  modified_base (458)..(458): a, c, t, g, unknown or other
  modified_base (482)..(482): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggatacgttggtccagccgtgggagggtccctggagctctcctgtcgtcgctctggtattccaccatcagtcgacctactatagtcggacgtcgggtcccgccgaggcctccggaggggaaggggcctggggagtggggcgttacgggcccgacgaaaacgtaaaaaaccgaaaggttcgacctacgttactttacnctaacgaagtacgtaccgccggtcgtcgtagtacgaaacncccgtagtaccttacccacccctntaaccgaaagtacgattcggtaaacctttcgaaaagtacctactatttaggactttcgagaacgtaagtcgaaacttaaacccgacgaaaaccggtacggaaaccgacgggtactagttagttaacgtttacgttggttgtttaagtttgttaactactacggaacggtaactcgtacccgg

SEQ ID NO: 439068 - DNA, 706 bp, Homo sapiens
  misc_feature: GZ8MTXP02IQ4FJ.44.36.D03.1.454.CMB.2.raw
  modified_base (235)..(235): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccatgtgaggtgcggctggtggagtcgtgggggagtcgttggtacgngggcgggggggtccctggacgactctcctgtgcagcctctggattcatcttcagtgactatgccatgaacgtcgggtccgcgaggcctaccggaaggggaacggggcttgggaggttcgggtttaccagttattaggtttaaatagtttgctggggtataactaaccccaccttaacctacgactagacttcgtaggtacgaaacggggcctaattaccaacctaagttcccgaaaggggacctaaagtcgaaacccaaaagtaaccttacgaacctttaggtaattaccgttaaagggaaaacttacgaaaacgtaacgtacccgtaggaaaggaaacgggaaacccgggaagggtaaacccgaaaccgggggtcctttaccggttaccgtttaaccctttcgttaagggtttaccggaaacggtacggtaacggttccccgggggtaaccctttaaccggtttcggggg

SEQ ID NO: 439069 - DNA, 606 bp, Homo sapiens
  misc_feature: GZ8MTXP02GJ7Q6.44.36.D03.1.454.CMB.2.raw
  modified_base (244)..(244): a, c, t, g, unknown or other
tcagacagtatatacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcacgtggtccagcaatgacagttgganatataaccttgtctcctgtatacaacaacatccagaccaaacgcccccaaactcattacttttgatccagtgagccggcgtcgtacgttgtttactagtccgtcttcctcgtcggcctacctaagttcctaggcccaccacgggtccccttcccgtcgtaccgtattcctcgttcgggcccttcccgggccgttaggacgggaccgaggtcctacgactttaacgtttacgacggtccggccttacgtaactttttaccaaccgttcttaggaacgtcggtttgggttcgttacgggcggtacggtacctccgaccgttcgaccgttcgtaacggtcaacgccgaacgtccgaccgtccccg

SEQ ID NO: 439070 - DNA, 602 bp, Homo sapiens
  misc_feature: GZ8MTXP02FWGXM.44.36.D03.1.454.CMB.2.raw
  modified_base (258)..(258): a, c, t, g, unknown or other
  modified_base (367)..(367): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtcagagtgaagtgcagttggtggagtccgggggagacttggtccagcctggaggtccctgagactctcctgngtcgctctggatcaccatcagtgaccatatatggactgggtccgcaggctccgaggggaaggggctgggagtggcttggccgcaagtaaaaacaagttgccagctttancacagagtacgcgcgtctgtagaaaacgccaagtacttacccacccctctaacaaaggagaatacgtaaccttacaaaagtaacctactaatttagatttccgtaggacgtaaatcgaaacctaaacccgtaacgaaaaaacccggacggaaccgacggggtacaagttagttaatttagttggttagtttaagtttagttttaactactacgtaaacggtaacctcggtacccg

SEQ ID NO: 439071 - DNA, 612 bp, Homo sapiens
  misc_feature: GZ8MTXP02F8SQJ.44.36.D03.1.454.CMB.2.raw
  modified_base (359)..(359): a, c, t, g, unknown or other
  modified_base (553)..(553): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaacggccctggagtggcttgcacacatcttctacgaatgaacgaaaatcctaacagtacatctctagagagctaagtttaaccatcctaccaaggaccacctacaaaggcaggtgttactttagtatgaaccacagtcggaccctgacggacacgacgcanatattactgtcgcaagggtaataggaacgggaaaagaaacgagtcgttggtttctagttatttaataagttacttaccattcgtagacgttcgtacggggacaaacggggtccgaaccggtacctaaccggtcctacccgtacgacgtccttacccgaaccgaccggcccgtacgtcccggttcccttccccgnggtcccgtccctcgacctccgacggtcgaccgtaccgtcggtcgggacacggcgcccgg

SEQ ID NO: 439072 - DNA, 801 bp, Homo sapiens
  misc_feature: GZ8MTXP02H7I36.44.36.D03.1.454.CMB.2.raw
  modified_base (221)..(221): a, c, t, g, unknown or other
  modified_base (309)..(309): a, c, t, g, unknown or other
  modified_base (400)..(400): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagtcttgggttttccttgtttgttattttacaaggtgtccagagtgaagtgctagttggtggaggtccgggganacgttggtccagccgtgggaggtccctgagactctctgtgtcgctctggatcaccatcagtcgaccactatagtggactcggggtccnccgaggcctaccgaggggaacggggctaggggaggtcgggcttcgggaccgacaaaggtaaaaacaaaggttccgaccgtaagtctttaanacaacgagacgttaaccgggccgtaccggttccgttaggtaacgaaaacgccccgtaaagtacctttacccgaaccccctttcgtaaaccgaaacgttaaaggtactacggtaaaccctttaacgaaacggtaaaccttacgtatttaggtaacttttacgaggtaacgaaaacgttcgaaaacccgttaaaacccggtaacgggaaaaaaccccgggaggtaaacccggaaacccgggggtaacttaacggttaaggggtttttaaattttaaacggtttgggttttacggttttaaccggggttttacgtttttaaaccaggtttaacccgtaaaaggggtaaacctttccgggtaacccgtaccggggtttaaccgggggacccctaaaacccggggg

SEQ ID NO: 439073 - DNA, 623 bp, Homo sapiens
  misc_feature: GZ8MTXP02FUZ9X.44.36.D03.1.454.CMB.2.raw
  modified_base (548)..(548): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagagactcaccatggagttgggctgcgcttgggttttccttgttgcttattttagaaggtgtccactgtgaggtgcggctggtggagtcgtgggggaggtcgttggtacgagggcgggggggtccctggagactctcctgtgcacgcctctggtattcattcttcagtgactatcgccagtacgaacgtcggtcccgccgaggcctaccggaggggacggggcgtgggaggtttggtttacagttagttagtttaattagttgcgtgggacgtactaaccctacctactacgactagtactcgtaggtaggaaacgggtcctaatttacccaaccttaaacgttcccgaaaggggtaaaccaagttaccggaaaccaaaagtaaccttcaacgttagttaactacgtaaggaaaactcgaaacnggtaccgtagaacgaggacgaggtacgacggtctcgtactcttgtgtacgacgacgtcgtccggccttaggttcg

SEQ ID NO: 439074 - DNA, 616 bp, Homo sapiens
  misc_feature: GZ8MTXP02H3NID.44.36.D03.1.454.CMB.2.raw
  modified_base (271)..(271): a, c, t, g, unknown or other
  modified_base (273)..(273): a, c, t, g, unknown or other
  modified_base (280)..(280): a, c, t, g, unknown or other
  modified_base (308)..(308): a, c, t, g, unknown or other
  modified_base (374)..(374): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttattttacaaggtgtccagagtgaagtgcagttggtggagtccgggggagacgttggtccaggcctgggacgggtccctgagactctcctgtgtcgctngnttcaccntcagtgaccactatatggactgggtccnccaggctccgaggggagggctggagtggctggccaccgaaagtaaaacaagttcaccagtctttancacgagacgtaccggccgcgttctagtagaaaggcccaggtacttcccaaccccgttctacgaaagacgatcgtaaacctttacgaaaagtaacccttctaagtttgaactttcgtaggaaccgtaaattacggaacccttaaaccgtacggaaaaaacccggtcggaaaccgacggggactaagtacggttattagtttgtgtttgttaggtttaatacgtacgaaggtactcggtacccg

SEQ ID NO: 439075 - DNA, 547 bp, Homo sapiens
  misc_feature: GZ8MTXP02GM95V.44.36.D03.1.454.CMB.2.raw
  modified_base (335)..(335): a, c, t, g, unknown or other
  modified_base (443)..(443): a, c, t, g, unknown or other
  modified_base (448)..(448): a, c, t, g, unknown or other
  modified_base (514)..(514): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaagacacctaccaaaggcaggtgtctttagtatgaccaacatcggacctgcgganaccgagcacatattactgtgcacgggtaaatggacgggaaaagaaacagctggttctgtattataagtctacatctgacgtgagggcaaagggccaacggcaccgtcncctcncgcttcccgacaacgggcccactccggtacttcccccgtggcccgcccgtcgccgtccaacgggcnccgtacctcggacgggggccaacgcggcccggg

SEQ ID NO: 439076 - DNA, 709 bp, Homo sapiens
  misc_feature: GZ8MTXP02FOFW4.44.36.D03.1.454.CMB.2.raw
  modified_base (647)..(647): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgcttattttagaaggtgtccactgtgaggtgcggctgggtggagtcgtgggggagcgttgggtacgagggcggggggggtccctggagactctccgtgtgcagcctcgtggattcatcttcagtgactatgcctatgaacgtcgggtcccgccgaggcctccggaggggaacgggcgtgggaggtgggtttccagttatagttaatagttgacgttgggaactactaccctacctaacgtacgcgaagtaccgttcgtaggtagggaaacggggtccctaagtttacccaacccgttaaatttccccgggaaaggggtaaacctaaagttaccgaaacccctaaaaggtaaacccttctaaccgttaggttaactaccgtaagggtaaaacttggaaacctacggaccgtagaaacggtaacggacggaaacgggacctaaccggggtcttaccggttaaccttacgtttttaccggnggtttaacccggaaaggttacggtacggttacccgggggtccctaaacggggtttttcgggg

SEQ ID NO: 439077 - DNA, 542 bp, Homo sapiens
  misc_feature: GZ8MTXP02FKHEP.44.36.D03.1.454.CMB.2.raw
  modified_base (226)..(226): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccagtaaagcccccaaatcatcatctatgaggcctataagaggccctgaggggtttcaactcgctcactgcctcagtccgcaacaccgcctcctgacaatctctcggctccgagctgaggacgaggctgaattatattgttgctcgagtatgttcttcgctatctacttatcgttcgttacggaacgttcgggaacctaaacgggtaccacccggttacctaaggggtaccaacggaccccgaaacggaccccaaaccccacttcg

SEQ ID NO: 439078 - DNA, 772 bp, Homo sapiens
  misc_feature: GZ8MTXP02GAZO9.44.36.D03.1.454.CMB.2.raw
  modified_base (302)..(302): a, c, t, g, unknown or other
  modified_base (316)..(316): a, c, t, g, unknown or other
  modified_base (396)..(396): a, c, t, g, unknown or other
  modified_base (458)..(458): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttggtccagccgtgggacgggtccctgagctctcctgtgtcgcctctggacttcaccatcagtcgaccatatanggactcggggtccncgaggcctaccggaggggaaggggctggggacgtggcttgggccacgaaagtaaaaaacaaggttcgacctagtctttanaccaacgagacgtacccgcgacgttctagtagaaacgcccgaagtacttcccaaccccgttntaacgaaaggtagaacttacggtaaacctttaccgaaaaggttaacccttactaaagttttaggtaaacctttccgtaaggacccgtaaaagttaccggttaaaaccttaaaaccccggtaagggaaaaaaaacccccggtgggaaaaccccggtaaacccgggggtactttaaaacggtttacgggttttaaaactttttaacgggttttgggttttaacgggtttttaacgggttttaaggttttttaaaacgttaacctttaacgggtaaaaccgggggttaaaccttttaccgggggtttaaacccccgg

SEQ ID NO: 439079 - DNA, 695 bp, Homo sapiens
  misc_feature: GZ8MTXP02JZ9EB.44.36.D03.1.454.CMB.2.raw
  modified_base (450)..(450): a, c, t, g, unknown or other
tcagacagtatatacacgaccggtgctcgatttagctgcgtcacgatctctcttgggagctctcagagaggtgccttagccctggattccaaggcattttccacttggtgatcagcactgaacacagaggactcaccatggagttgggctgcgcttgggttttccttgttgcttattttagaaggtgtccactgtgaggtgcggcgtggtggagtcggtgggggagtcgttgggtacggagggccggggggggtccctggacgacttcgtccgtggtcgcagccctcgtggtacttcattcttcgagtgactagtcgccagtcgaacgtcggggtcccgccgaggccgtaccggaaggggaacggggcgtagggaggtttgggtttaccagttagtttagtttaaatgttgcgtggatactacccacctacacgcacgaccttcgtaggnggaacgggtccatttacccgaacctaacgttaccgaagggtaccaagtaccgtaaaccgaaacgtaaacctacctaacgttacggttaacgtaccgttaaaaggtaaaagtacgaaaaccgtacgccgtaaaaggaacggaaacgggaaacggaaacggaaccgtaaccggtcttaccggttaccttaacggtttcgttaaggttacgaacggtacggaccggttccggtacctcggtttacggg

SEQ ID NO: 439080 - DNA, 444 bp, Homo sapiens
  misc_feature: GZ8MTXP02IW3J0.44.36.D03.1.454.CMB.2.raw
  modified_base (434)..(444): a, c, t, g, unknown or other
tcagacagtatatacacgaccggtgctcgatttagctgcgtcacgatctctcttggggctggatccggcagcccccagggaggggaatggagtggattggtgacatccattatactggggcgacgtactactctccgtccctcaagagtcgtctcaccatttcgagggacacgtccatgaaccgcttctccctgaaactgacctccgtgaccgccgcggacacggccgtttattctgtgcgaggcgagactggtctttcaatctatggggccgtggcaccctggtcactgtctcctcagcttccaccaagggcccatcggtcttccccctggcgcccctgctccaggagcacctctcgggggcacagcggccctgggctgcctggtcaaggctactcctatatactgtctgagcgggctggcaaggcgcatagnnnnnnnnnnn

SEQ ID NO: 439081 - DNA, 837 bp, Homo sapiens
  misc_feature: GZ8MTXP02I33BK.44.36.D03.1.454.CMB.2.raw
  modified_base (418)..(418): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacactattcttctacgaaatagaaacgaaaatcctaacagtacatcctctagaagagactaacgtttaaaccatacctaaccgaaaggaccaaccgtaaccaaaaggccgtaaggttggttactttaagaactcgaaaccctaaatacgtaccggaacccctggaccggaacaaccgacgacaactaacttattacgngtacgacgtaaacgggttaaagtacgggaaacggggtaaaaagaaaccgtaggtaccgtttaggtttacttaagttaaaagtttaaagttaaaacgtttaaacttaacccgtaacgtttaccgtacggggtaaccgttacggggtaacgggggtaaaccggtaaaaccgggggacccgtaaaccgggttccccgtaaaccccggttcccttcccgtacggaccgtaccccttacccgaaacccggaaccggggtaccccctaaccgggttcccccgggtttaccccccgtttcccccccgggcggggtaccccccgttccccgtcccgggtaccccgttaccccggaacgggggaacccgacccggttaccccggttaccggggtccgggggacccaaccgggccgggtcccccggggg

SEQ ID NO: 439082 - DNA, 593 bp, Homo sapiens
  misc_feature: GZ8MTXP02JDNS7.44.36.D03.1.454.CMB.2.raw
  modified_base (209)..(209): a, c, t, g, unknown or other
  modified_base (223)..(223): a, c, t, g, unknown or other
  modified_base (346)..(346): a, c, t, g, unknown or other
  modified_base (372)..(372): a, c, t, g, unknown or other
  modified_base (376)..(376): a, c, t, g, unknown or other
  modified_base (389)..(389): a, c, t, g, unknown or other
  modified_base (394)..(394): a, c, t, g, unknown or other
  modified_base (463)..(463): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaaggtgtccagagtgaagtgcagttggnggagtccggggganacgttggtccagcctgggaggtccctgagctctcctgtgtcgcctctggacttcaccatccagtcgacctactatagtggactgggtccgcaggctcgagggagggctggagtggctggccanaaagtaaaaacagtgccagtctttancaanagagtacgcgctnagtanaaagccagcttacccacctctacgaaagacgatcgaacttacaaacgtaactcaatttggaactttcgnggaacgtaaattacggaaacccttaaaccgtagaaaaaacccggtggaaaccgaacggggctaaatggtttaacttagttggttagtttggttactttaacgtagtcgaaagggtaaccttgtaacccgg

SEQ ID NO: 439083 - DNA, 588 bp, Homo sapiens
  misc_feature: GZ8MTXP02F2I16.44.36.D03.1.454.CMB.2.raw
  modified_base (371)..(371): a, c, t, g, unknown or other
  modified_base (380)..(380): a, c, t, g, unknown or other
  modified_base (407)..(407): a, c, t, g, unknown or other
  modified_base (503)..(503): a, c, t, g, unknown or other
  modified_base (548)..(548): a, c, t, g, unknown or other
  modified_base (564)..(564): a, c, t, g, unknown or other
  modified_base (579)..(579): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatagaaacgaaaatcctaacagtacatctctagaaagagctagtttaaccatactaccgaaggaccacctaaccaaaaggcaggtgttactttagtatacgaaccaacagtacggaccctggacgacaccgagcanatacttacngtgcgaacgggtataggacgggaaaanaacgagtacgttgtttctagtattaataacgttcttacatcgtacggtacgtcggtaggggaacgaaacgggcctacgtccaccggtcctaccgtnacgtcctaccgaccgacggtccacgtccgtccctccccgtgcccncctcgcctcgagaacncaccgtcggcggacncgcgcccgg

SEQ ID NO: 439084 - DNA, 642 bp, Homo sapiens
  misc_feature: GZ8MTXP02J15SY.44.36.D03.1.454.CMB.2.raw
  modified_base (316)..(316): a, c, t, g, unknown or other
  modified_base (360)..(360): a, c, t, g, unknown or other
  modified_base (368)..(368): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaaggtgtccactgtgaggtgcggctggtggagttcgtgggggaggcttgggtacgagggcgggggggtccctggagactctcctgtgcagcctcgtggattcatcttcagtgactatgccatgaacgcggtccgcgnggctaccggaggggaagggcgtggagtggttccatatgttaatntgctgganactaccacctacacgcagactctggtagaaacgggcccgtaattcccgaacctaacttcccgaaaggggtaccaagcggaacccaaaggaaccttcgaaccgttaggttaaactaccgtaagggtaaaatacgaaaacgtgaccccgtaagggaacgaacggaaccgagggtaaccaaccggggtcttaccggtaccttaaaccgtttccggtaacggtttacccggaaggtacgggtaacgttcccgggggtaaccccttagggtttccgggg

SEQ ID NO: 439085 - DNA, 548 bp, Homo sapiens
  misc_feature: GZ8MTXP02I5WVJ.44.36.D03.1.454.CMB.2.raw
  modified_base (396)..(396): a, c, t, g, unknown or other
tcagacagtatatacacgaccggtgctcgatttagctgcgtcacgatctctcttgggagctctcagagaggtgcccttagccctggattccaaggcatttccacttggtgataagcactgaacacagaggactcaccatggagttggggctgcgctgggttttccttgttgcttattttagaggtgtccactgtgaggtgcggctgggtggagtcgtgggggagcgttggtacgaggccgggggggtccctgagactctcctgtgcagcctctggattcatcttcagtgactatgccatgaacgtgggtcccgccgaggctcccgaggggagggctggtagtgggtttcattatgttaatagttgctggagactacccacctactacgcagacctntgtagaacgggccgtattccactaattcccgagggtacaatgaccaaagtactactactgttactacgtaaggaatagaacagccgtagagagaacgaggacacggctcgtactacttcgtgtgagtacgacgtcggacctacgttcgtacg

SEQ ID NO: 439086 - DNA, 787 bp, Homo sapiens
  misc_feature: GZ8MTXP02JGYE0.44.36.D03.1.454.CMB.2.raw
  modified_base (304)..(304): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgctaggttggtgggagggtccgggggagtacgttgggtcccaggcccgtggggtacgggtcccctggagacctctccgtggtcgtccgcctgtggacttcaccntcagtcgacctactatagtcggacgtcgggtcccgcgaacggtccgtaccgggaagggggaaggggtccgtaggggtacggtgggtccgttcggggacccgtaccgtaaaaggtaaaaaaccgtacgtttcgaccctaaggtcctttagtccaaacgtacgggtacgttaacccggcccggtccgtcgttagggtaacggaaaaccgtcccgtaaacgtaccttaacccacccccttacttaaccgaaaaggacgtaacgttacgtaaacccttaacgtaaaccggtaacttactacgtttacgtaactttcgtaacgtacgtaaacgtacggtaaacccttaaaccgtaaaaccggtaaaaacccggggtaacggaacccggtacggggtaaaccttaggttagtttaacgtttagtttaggtttacgtttaaggttttacgtttaattacgtacgtacggttaaaccgttcgttaacccgg

SEQ ID NO: 439087 - DNA, 743 bp, Homo sapiens
  misc_feature: GZ8MTXP02JKS56.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaaggccctggagtggcttgcacacatcttctcgaatgaacgaaaatcctacagtacatctctgaagagactagtttaaccatcctaccgaaggaccacctacgaaaggcaggtgtacttagtatagaccaacatcggaccctggaccggacaccgagacacattattactgtgacgaacggggttaagtacggaacggggaaaagaaacaggtcctttagggtttactagttaattttaaagtaacgtttccttaacccgagtttacgtacgggtaacgttccggttagggggacctaaaaacgggggtaccctaaccgggggttcccaaccccgggtttaccttacccgtcccgaacggttcccctttacccgaaaccgggaaacccggggtcccaaccggtttccccgggttccccttttcccccccggcgggacccccgttcccgttcgggacccttccccgggaaaacggggtccccgaccccggttaacccgggttccgggggtacccggggacctaacccgggcccggggtccccggg

SEQ ID NO: 439088 - DNA, 848 bp, Homo sapiens
  misc_feature: GZ8MTXP02F5L9E.44.36.D03.1.454.CMB.2.raw
  modified_base (227)..(227): a, c, t, g, unknown or other
  modified_base (276)..(276): a, c, t, g, unknown or other
  modified_base (410)..(410): a, c, t, g, unknown or other
tcagacagtatatacacgaccggtgctcgatttagctgcgtcacgatctctcttgggggagctctgagagcggagccccagccccagaattcccaggtgttttcatttggtgatcagcactgaacacagaggactcaccatggagttcgggctgagcttgggttttcctgttgttattttacaaggtgtccagagtgaagtgctaggttggtggaggtccggggganacgttggtccagccgtggacgggtccctgagactctcctgtcgtcgctntggatcaccatcagtcgaccatatatggacgtcgggtccgccgaggcctccgaaggggacggggtctaggggagtgggcgttcgggccgtacgaaaagttaaaaaacaagtttcggaccctaagttacttttanaccgaacgtacggtacgttaaccgcccggtcgttacgttaggtaacggaaaaccgcccgtaagtactttacccgaacccccttcttaaaccgaaaacggagtaacgttcggttaaaaccctttcgaaaaacggtaaaaccctttacgttaacgttttacgtaaacgtttaccgtaacggtaaaccggttaaaacgtttaaaccggaaaaccccgtttaaaaacccggtaaaaccggggaaaaaaaacccccggggtacggggtaaaaccccggggtaaacccgggggttaacttaaaacggttttaacggtttttaaaacgttttaacgggttttacgggtttttacgggttttaacggtttttaaacggtttttaaacgttaaaccggttaccgggttaaaacgggtttaacccgtttaccccgggttaaccccggg

SEQ ID NO: 439089 - DNA, 619 bp, Homo sapiens
  misc_feature: GZ8MTXP02H9W1R.44.36.D03.1.454.CMB.2.raw
  modified_base (272)..(272): a, c, t, g, unknown or other
  modified_base (397)..(397): a, c, t, g, unknown or other
  modified_base (454)..(454): a, c, t, g, unknown or other
  modified_base (467)..(467): a, c, t, g, unknown or other
  modified_base (492)..(492): a, c, t, g, unknown or other
  modified_base (587)..(587): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcaggttggtgggaggtccgggggagtacgttgggtccagcctggagggtccctgagactctctgtgcgcctnggattcaccatcagtgaccactatatggacgtgggcccgcgaggcctaccggaggggaaggggtctgggaggtgggacgttgggccacgaaaagtaaaaaaccgaagttcgactaggtcttttancctaacaggtacgtaccgccggatcctgtagaaacgcccaagtactccaaccccttnaccgaaagacgtntacggtaacttacaaagtaccttanatttcgaatttccgaggaccgtaaatcgtaaacctaaccgtaacggaaaacccgaggaaccgcggactagtagtatttagtgttgttaacggttntttaaatgtacgtacggtaacttcgtaaccgg

SEQ ID NO: 439090 - DNA, 602 bp, Homo sapiens
  misc_feature: GZ8MTXP02FIJ51.44.36.D03.1.454.CMB.2.raw
  modified_base (396)..(396): a, c, t, g, unknown or other
  modified_base (442)..(442): a, c, t, g, unknown or other
  modified_base (450)..(450): a, c, t, g, unknown or other
  modified_base (521)..(521): a, c, t, g, unknown or other
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagctgggttttccttgttgttattttacaaggtgtccagagtgaagtgcagttgggtggaggtccgggggagacgttggtccagccgtgggacggtccctgagactctcctgtgtcgctcgtggatcaccatcagtcgaccactatagtggacgtcgggtcccgccgaggcctccggaggggaaggggctgggaggtggcgttgggccgacgaaagtaaaaacaagttcgaccagtctttancacagtacgtacgcgcgtctgtagaaacgccaagtcttccaccctntacgaagngatcgtacttacaaagtactcgtattgattcgtagacgtaaatcgaaacctaaaccgtaacggaaaaccgnggaaccgacgggtactaagttcggttaatttagttggtttagttgttagttttaatactacgaacggtaacttcgtaaccg

SEQ ID NO: 439091 - DNA, 644 bp, Homo sapiens
  misc_feature: GZ8MTXP02IPMOL.44.36.D03.1.454.CMB.2.raw
  modified_base (209)..(209): a, c, t, g, unknown or other
  modified_base (277)..(277): a, c, t, g, unknown or other
  modified_base (319)..(319): a, c, t, g, unknown or other
  modified_base (439)..(439): a, c, t, g, unknown or other
  modified_base (465)..(465): a, c, t, g, unknown or other
  modified_base (478)..(478): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccgggggagacttggtccaggcctgggacgggtccctgagactctcctgtgtcgcctctaggnttcaccatcagtcgacctactatagtggacgtcggggtcccncgaggcctaccggaggggaaggggtcgtgggaggtcgggtcgttcggggccgaacgaaacgtaaaaaaacgaaggtttcgacctaagttcctttagcaacgagacgtaccgccgcgttcngtagaaacgcaagtcttccacccctntacaaagacgtanacgtacttacaaaagtacttcaatttcgaactttcgagtaccgtaaatcggtaaacctaaacgtaaacgaaaacccgtggaaaccggtacgggactaagttacgttatttaacgttgttagttaaggtttctttaaatatacgtaacgggtaacttcgtaacccgg

SEQ ID NO: 439092 - DNA, 640 bp, Homo sapiens
  misc_feature: GZ8MTXP02GSZ60.44.36.D03.1.454.CMB.2.raw
  modified_base (331)..(331): a, c, t, g, unknown or other
  modified_base (565)..(565): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgctaggttggtgggacggtccgggggatacgttggtccaggccgtgggacgggttccctgacgtctctcctgtgtccgcctctggattcacctatcagtcgaccactatagtggacgttcggggtcccnccgaggcctaccggaggggaacggggtctgggagtcggtcgtcgggaccaacgtaaacgtaaaaacgaagttcggacctagttactttacgccaacgtaggtacgtaccgccggtacgtcgtagtacgaaacgcaagtacttcccaccctctacaagagtactacgaacttacaaagtacttcgtattagacttcgagacgtaatacgaacccttaacgaaacgaaaacccggnggaccgacggtactagtagtttattattggttagttgttacgtttatacgtacgtaacggttactcgtaacccgg

SEQ ID NO: 439093 - DNA, 601 bp, Homo sapiens
  misc_feature: GZ8MTXP02IW14F.44.36.D03.1.454.CMB.2.raw
  modified_base (393)..(393): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagccccccgagggaaggccctggagtggcttgcacacatcttctcgaatgacgaaaatcctacagtacatctctagagagcagtttaaccatctccaaggaccacctacaaaggcaggtgtctttagtatgacccaacatacggaccctgcgacaccagcacgatacttactgtcgacgacgggtaatgacggggtaaaagaaacgngtacgtgttttctagttaagtttaattaaacgtacttacccgattcgtaggacgtcgtaggggacaaacgggccgacggtcctaccggtctcctcacgtcctaccaccgaaccgggcccagttcccggttactcccccgtcggtccggccctacgcccgtaccgacggaaccgtccgaccgttccgcgggggcaccggcggccccggg

SEQ ID NO: 439094 - DNA, 656 bp, Homo sapiens
  misc_feature: GZ8MTXP02IB19Y.44.36.D03.1.454.CMB.2.raw
  modified_base (281)..(281): a, c, t, g, unknown or other
  modified_base (423)..(423): a, c, t, g, unknown or other
  modified_base (580)..(580): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgtttattttacaaggttgtccagagtgaagtgcgtaggttggtggaggtccgggggagtacgttggtccagccgtggacgggtcctgagtactctctgtgtcgcctntggtattcaccatcagtcgacctactatagtcggtacgtcgggtcccgccgaggcctaccggaaggggaggggcgtagggaggtgggtccgttcggaccgacgaaaacgtaaaaaccgtagttcgacctaggttcttttacncgtaacgaggtaaccgtaccgccgtcgttacgtagtagaaacgcctaacgtacttcccaacccgttctacgaaaggtacgatacgtacttacgaaagtaccttcagtttacacttcgagtacgaatacgtaaacctaaccgtaaacggaaaacccgnggaacgtacggctaagttagtatttacgtttgttagttaagttatttaacgtacgtacgtacggtacttcgaccgg

SEQ ID NO: 439095 - DNA, 651 bp, Homo sapiens
  misc_feature: GZ8MTXP02I59ZB.44.36.D03.1.454.CMB.2.raw
  modified_base (410)..(410): a, c, t, g, unknown or other
  modified_base (464)..(464): a, c, t, g, unknown or other
  modified_base (472)..(472): a, c, t, g, unknown or other
  modified_base (549)..(549): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttgggtccaggccgtgggacggggtccctggagactctcctgtgtcgcctctggactcaccatcagtcgaccactatacgtggactcgggtccgccgaggcctccggaggggaaggggctagggaggtcgggcgttcgggacccgacgtaaaggtaaaaaacgtaaggttcgaccctagtcttttaacncaacgaggacgtaccgccggtcgtctagtagaaacgcaagacttccaacccttnacaaaganactagtaacttacaaagtactactattgattcgacgacgtaaattcgaaaccttaaacccgtaaggaaaaacccggngaaaccgacgggaactagtagtttattaagttgttacgtttagttacgtttaatagtaacgaggttaaacctcgtacctaacgggcgggaccgtaaccgggg

SEQ ID NO: 439096 - DNA, 607 bp, Homo sapiens
  misc_feature: GZ8MTXP02H8CO7.44.36.D03.1.454.CMB.2.raw
  modified_base (276)..(276): a, c, t, g, unknown or other
  modified_base (318)..(318): a, c, t, g, unknown or other
  modified_base (365)..(365): a, c, t, g, unknown or other
  modified_base (396)..(396): a, c, t, g, unknown or other
  modified_base (414)..(414): a, c, t, g, unknown or other
  modified_base (476)..(476): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagctgggttttccttgttgttattttacaaggtgtccagagtgaagtgcgtagtttggtgggaggtccgggggagaccttgggtccaggcctgggacgggtcctgagctctcctgtgtcgcctntgattcaccatcagtgacctactatatcggacttgggtcccncccgaggcctaccggaggggaaggggctgggagtggcgttgggaccncgaaagtaaaaacaagttgcctagcttttanacaacgagacgtccgcgngtctagtagaacgcagtactccaccctcaacaagagtatacgtacttaacgaaactaacttnaattgtattcgagacgtaatacgtaaacctaaacgaaacggaaaaccggaggaaccgacggactaagttacgtttaacttagtttggttagtttaacgttatttaagtactacgaacgtaacgttcgaccg

SEQ ID NO: 439097 - DNA, 548 bp, Homo sapiens
  misc_feature: GZ8MTXP02HIEX0.44.36.D03.1.454.CMB.2.raw
  modified_base (306)..(306): a, c, t, g, unknown or other
  modified_base (316)..(316): a, c, t, g, unknown or other
  modified_base (335)..(335): a, c, t, g, unknown or other
  modified_base (343)..(343): a, c, t, g, unknown or other
  modified_base (372)..(372): a, c, t, g, unknown or other
  modified_base (379)..(379): a, c, t, g, unknown or other
  modified_base (418)..(418): a, c, t, g, unknown or other
  modified_base (422)..(422): a, c, t, g, unknown or other
tcagacagtatatacacgaccggtgctcgatttagctgcgtcacgatctctcgttggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactaggaactaatactgatgttagaaaatataacttgtctctggtacaagtactacccaacgtaaacccccaaactccttacttangaaagtcaanaacgcgcctggctatttcnatctctcncacgctacaagtctggcaacgcgctcgtnatattcngtcctctgcctgacgacgacggctactattatcgctgcnaatntggcggtactagagttagtcgggtcgttcgggcggagggcccggctcggacccgtcgtacggcaacgcccgaagggtcctccggcccccgtcggtcctacgttcctccggttcccccacctttccc

SEQ ID NO: 439098 - DNA, 556 bp, Homo sapiens
  misc_feature: GZ8MTXP02FPCCE.44.36.D03.1.454.CMB.2.raw
  modified_base (374)..(374): a, c, t, g, unknown or other
  modified_base (479)..(479): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtccgccaggctccgaggggaaggggctgggagtggcttgggccgacaagtaaaaacaaagttcgaccagtctttancacagcgtacgccgagtctgtgaaagccaagacttcaccctctacaagagatgacttcaaagaactcaattgattctgacgaaatgaacctaactagaaaaccgngaacgacgggacagtgtattattgtgttagtagtttatataacgaggtaactgtaccagttcgggggaccaacgggg

SEQ ID NO: 439099 - DNA, 670 bp, Homo sapiens
  misc_feature: GZ8MTXP02IZY0C.44.36.D03.1.454.CMB.2.raw
  modified_base (225)..(225): a, c, t, g, unknown or other
  modified_base (292)..(292): a, c, t, g, unknown or other
  modified_base (318)..(318): a, c, t, g, unknown or other
  modified_base (409)..(409): a, c, t, g, unknown or other
  modified_base (459)..(459): a, c, t, g, unknown or other
  modified_base (468)..(468): a, c, t, g, unknown or other
  modified_base (496)..(496): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcagttggtggaggtccggggganacgttggtccagccgtgggacgggtccctgacgactctcctgtgtcgcctctgatcaccatccagtnacctatatagtggacgtcgggtcccncgaggcctaccggaggggaaggggctagggagtgggtccttggggacccgacaaaaggtaaaaaaccaagttcgaccctaagttactttancaacagacgtaccgcgcgtactgagaaacgccaagtacttcccacccgtntacgaaagngaatcgtaaaccttacgaaagtaacctntaagttgaactttcgaggaaccgtaaattacggaaaacccttaaaccggaaacggaaaaaaccccggtggaacccgaacggggtacctaaagtttaacgttaacgtttaagtttgggttagttttaaggttacctttaaatacgtaccgtaaggggaactttccgggtaacccg

SEQ ID NO: 439100 - DNA, 622 bp, Homo sapiens
  misc_feature: GZ8MTXP02IYNCF.44.36.D03.1.454.CMB.2.raw
  modified_base (385)..(385): a, c, t, g, unknown or other
  modified_base (462)..(462): a, c, t, g, unknown or other
  modified_base (540)..(540): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttatttacaaggtgtcagagtgaagtgcagttggtggaggtccgggggagacgttggtccagccgtgggagggtccctgagactctcctgtgtcgcctctggattcaccatcagtcgaccatatagtggactgggtccgccaggctccgaaggggagggctggagtggcttggccgacaaagttaaaaaacaagttcgaccagttctttancaacagagtacgccgcgtctagtagaaagcccaagacttccaacccctctaccgaaaggtcaaagtgtaaaccttanaaaagtaaaccttcccaaatttgtaactttccgtggaccgtaaaatcggaaacccttaaaccgagaaaaaacccgggnggaaaccgacgggactagttacgttatttacgttgttaggtttaagttacgtttaatacgtacgtaacggtaactcgtaccg

SEQ ID NO: 439101 - DNA, 683 bp, Homo sapiens
  misc_feature: GZ8MTXP02JDB4G.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggacacctaccaaaggcaggtgtcttagtatgacaacatcggacctgcggacaccgaggcacatacttactgtgacgaacgggtaagtacggaacgggaaaacgaaacgtagtaccgttaggttttacttaggttaaatttagttaaagtttacccttaaccgattcgtacgggtacgttcggttacgggggaaccgaaacgggggtaacccgaccgggttaccaacccgggttccttacccgtacgaacggtccccttaacccgaaccgggtaaaccggggtaccccctaacggtttccggttacccccgttcccccgttcgggccccgttcccgtcgtcccgtaccgacggtaaccgcccgtaaccggttcggggacgggccgacgccgggtccccggg

SEQ ID NO: 439102 - DNA, 753 bp, Homo sapiens
  misc_feature: GZ8MTXP02FNQXN.44.36.D03.1.454.CMB.2.raw
  modified_base (323)..(323): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgctaggttggtgggaggtccgggggagtacgttggtccaggccgtgggacgggtccctgacgctctcctgtcgtcgcctctggattcaccatcagtcgaccattatatggacgtcgggtcccncgaggcctccggaaggggaacggggctaggggagttgggcgtttcggggaccgtaccgaaaagtaaaaaaccgtaaaggttccgaccctaaggttcttttacgaccgaacgtaagtacggtacccggtcccggtacgttcgtagggtaagaaaaccgtcccgtaaagtacctttccccgaaccccttcgtaaacgaaaggtagtaacttaggtaacccttacgaaaacgtaacccttagtaacttttggtaatttcccgaggtaaccgtaaacgttacggaaacccttaaaacccggaaacggaaaaaaccccgggagggaaaccggtacgggggtactaaggtttaggtttaaaacttttacggtggttttagtttcggtttaagttttaacttacgtaaccggtaaggtaacctttcggtaaacccgg

SEQ ID NO: 439103 - DNA, 766 bp, Homo sapiens
  misc_feature: GZ8MTXP02I631S.44.36.D03.1.454.CMB.2.raw
  modified_base (531)..(531): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctgagtcgttgggttttccttgttgtttattttacaaggtgtccagagtgaagtgctaggttgggtgggagggtccgggggagacgttcgggtccaggtcccgtgggtacgggtccctgagactcctcctgtcgtcgcctgtgacttcacctatcagtcgaccactatagtcggacgtcgggtcccgccgacggccgtaccggaaggggaacggggtcgtgggtaggtcgggtccggttcgggaccgtaaccgaaaacgtaaaaaacgtaaggtttcgacccgtagtttacctttagtaccgaacgtaacggtacgtaacccggcccgtacgttcgtaggtaaaggaaaccgacccgtagtaccctttcccaccccgttnaacgaaaggtatactacgtaaaccttacgaaaagtacccttattaatttggtaacttccgttaggaaactaacggttaacgaaaccccttaaaaacggtaaaccgggaaaaaaccggcgggtaaaaccgtaccgggtaactaagggttaacttttaacgtttagtttaacggtttggtttaaccggtttaatttacgtaaacgtacgtaaaccggttacgttccggtaaacccgg

SEQ ID NO: 439104 - DNA, 648 bp, Homo sapiens
  misc_feature: GZ8MTXP02HWES3.44.36.D03.1.454.CMB.2.raw
  modified_base (219)..(219): a, c, t, g, unknown or other
  modified_base (308)..(308): a, c, t, g, unknown or other
  modified_base (360)..(360): a, c, t, g, unknown or other
  modified_base (394)..(394): a, c, t, g, unknown or other
  modified_base (431)..(431): a, c, t, g, unknown or other
  modified_base (459)..(459): a, c, t, g, unknown or other
  modified_base (533)..(533): a, c, t, g, unknown or other
  modified_base (590)..(590): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacgttggtccagccgtggacggtccctgagactctctgtgtcgctctggattcaccatcagtcgaccactatagtggacctgggtcccncagggtcctccggaaggggaacggggctaggggagttgggcgttgggccganaaaggtaaaaacaagttccgacctagtctttaancaacagacgtaccgccgtcgtccgtaggtacgaaacncccagtactcccaccctctacaaagtanactagtaacttacgaaatacctatagttagaactttcgagacgtaatacgaacttaaaccgaagaaaacccggnggtaaaccgagggtactaagtagtttattagttaggttagtttagtttacgtttaanaagttccgaaaggttaccttcggtacccgaacggggtcggggtaacccaaaccggggg

SEQ ID NO: 439105 - DNA, 796 bp, Homo sapiens
  misc_feature: GZ8MTXP02I3Y21.44.36.D03.1.454.CMB.2.raw
  modified_base (283)..(283): a, c, t, g, unknown or other
  modified_base (286)..(286): a, c, t, g, unknown or other
  modified_base (327)..(327): a, c, t, g, unknown or other
  modified_base (425)..(425): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacgaaggtgtccagagtgaagtgctaggttggtgggaggtccgggggatacgttggtccaggccgtgggacggtccctgacgtactctcctgtcgtcgcctntgnttcaccatcagtcgacctactatagtggacgtcgggtcccnccgacggcctaccggaaggggaacggggtcgtgggaggtcggtccgttcgggccacgtaaaaggtaaaaacctaaggttcgacctaaggttcctttanaccaacgtagtaccgtaccgcccgtcgttcgtagtaggaaaaccgcccaaagtaccctttacccacccccttacgtaacgaaaggtacgtaacttcggtaaacctttaacaaaacggtaacccttacgttaagttacggttaacttcccgtaggaaccgttaaaacgtaaccggtaaaccccgtttaaaacccgtaaaacgggtaaaaaccccgggtaacggggaaaccggtaaacccgggggtaccttaaagggttttacgtttaaaacgtttttacggtttgggttttaaccggtttaaggttttaacgtttttaaacgtaacgttaccggtaaaacggggttaaccctttcggtttaaacccccgggg

SEQ ID NO: 439106 - DNA, 649 bp, Homo sapiens
  misc_feature: GZ8MTXP02JYNZX.44.36.D03.1.454.CMB.2.raw
  modified_base (320)..(320): a, c, t, g, unknown or other
  modified_base (490)..(490): a, c, t, g, unknown or other
  modified_base (525)..(525): a, c, t, g, unknown or other
  modified_base (532)..(532): a, c, t, g, unknown or other
  modified_base (583)..(583): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcaggttgggtggaggtccgggggagtacgttggtccaggccgtgggacgggtccctgagtactctccgtgtgtcgcctcgtggacttcacatcagtcaccatatgtggacgtcgggtccnccgaggcctaccggaaggggacgggcgtagggaggtcggtcgtcgggaccgacgtaaaagtaaaaaaccgtaagggttacgaccgtaaggttactttacacgtaacgaaggtaccgtaaccgcccgtcgttacgtaggtaacgaaacggcccaagtacttacccaccctnacaaagcgatacggtaactacaaagtactacattntagttcnggaactagtacggaaccttaaacgaaacgtaaaacggacggacgacggtanaagttcggttattacgttggtttagttggtttattaacgtactaggtacggttacctacgtaccgg

SEQ ID NO: 439107 - DNA, 701 bp, Homo sapiens
  misc_feature: GZ8MTXP02FJCQ6.44.36.D03.1.454.CMB.2.raw
  modified_base (306)..(306): a, c, t, g, unknown or other
  modified_base (371)..(371): a, c, t, g, unknown or other
  modified_base (424)..(424): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggatcaccatcagtgaccatatatggactgggtccncaggctccgagggaggggctgggagtggcttggccgacaagtaaaaacaagttgaccagctttancacagagtaccgcgcgtctgtagaaaacgccaagtacttacccacccccgttntaccaaaaggacgtaagttggtaaacctttacgaaaaggtaaccttcgtaattttacgggaactttttacccgaggacccgtaaaagtttccggaaaccctttaaaacccggttaaggaaaaaaacccccggtaggggtaaacccaaacccggggggtacctaaacggttttagggtttaaacctttttaaacgtttgggtttacggttttaaggtttaacggtttttaaatacggttaccgtaaaaggggtaaaccctttcggtttaaacccccgg

SEQ ID NO: 439108 - DNA, 667 bp, Homo sapiens
  misc_feature: GZ8MTXP02G5QOJ.44.36.D03.1.454.CMB.2.raw
  modified_base (319)..(319): a, c, t, g, unknown or other
  modified_base (419)..(419): a, c, t, g, unknown or other
  modified_base (449)..(449): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagtcttgggttttccttgttgttattttacaaggtgtccagagtgaagtgctaggttgggtggaggtccgggggatacgttggtccaggccgtgggacgggtccctgacgtactctcctgtcgtcgcctctgatcaccatcagtcacctactatagtggacgtcggggtccncgaggcctaccggaaggggagggtcgtggggtaggtcgggtcgttgggacccgacgtaaaacgtaaaaaacgaaggttccgaccctagtctttacaccanagcgtaccggccgtcgtctaggtagaaacnccaagtcttcccaccttcacgaagagtactagtacttaacaaagtacctatattacgtactttgacgataaataccgaaaaccttaacctaaaggaaaacccggtgggaaaccgacgggtactaacgttagttaattagtttgttagtttagtttagtttacttagtaacgtaacgtacgttacgtacgtaccggggtcgggtaaccgtaacccgggg

SEQ ID NO: 439109 - DNA, 569 bp, Homo sapiens
  misc_feature: GZ8MTXP02JDMWK.44.36.D03.1.454.CMB.2.raw
  modified_base (303)..(303): a, c, t, g, unknown or other
  modified_base (343)..(343): a, c, t, g, unknown or other
  modified_base (372)..(372): a, c, t, g, unknown or other
  modified_base (375)..(375): a, c, t, g, unknown or other
  modified_base (388)..(388): a, c, t, g, unknown or other
  modified_base (422)..(422): a, c, t, g, unknown or other
  modified_base (465)..(465): a, c, t, g, unknown or other
  modified_base (496)..(496): a, c, t, g, unknown or other
  modified_base (535)..(535): a, c, t, g, unknown or other
tcagacagtatatacacgaccggtgctcgatttagctgcgtcacgatctctcttgggggagagtggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccnccaggctccgaggggaagggctgggagtggcttggccganaagtaaaaacaagttcgaccagtctttancanagagtaccgccgngtcctgtagaaacgccagtacttcccgaaccctntacaaagagatcgacttacaaagtaacctctattgactttcgngacgtaatgaacctaacgtagaaaacccggnggaacacgggctaagtgtattagtgtgtttgtagtttanagtcgaggaactcgtcacgtcggggactaacggg

SEQ ID NO: 439110 - DNA, 659 bp, Homo sapiens
  misc_feature: GZ8MTXP02GHE0D.44.36.D03.1.454.CMB.2.raw
  modified_base (274)..(274): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccgggggagacttggtccagcctgggagggtccctgagactctcctgtgtcgcctctggnttcaccatcagtgaccactatatggactgggtccgccaggctccgaggggaaggggctgggagtggcttgggccgcgaagtaaaaacaagttcgacctaagtcctttagtccaacaagagtaaccgcgacgtctgtagaaacgccagattccaccctctacaacgagatcgaacttcaaagtactactattagacttacagacgtaagttacgaacctttaaaacccgcgaaaaaaaccccgggagggtaaaacccgaacgggggtacctaaacggttacggttaacttttaaaacgtttggtttaagggttttggtttaaccggtttttaaattaaagttacccggtaaaagggttaaacccgtttacgggtttaaacccccgg

SEQ ID NO: 439111 - DNA, 563 bp, Homo sapiens
  misc_feature: GZ8MTXP02FQVHZ.44.36.D03.1.454.CMB.2.raw
  modified_base (203)..(203): a, c, t, g, unknown or other
  modified_base (217)..(217): a, c, t, g, unknown or other
  modified_base (303)..(303): a, c, t, g, unknown or other
  modified_base (348)..(348): a, c, t, g, unknown or other
  modified_base (378)..(378): a, c, t, g, unknown or other
  modified_base (395)..(395): a, c, t, g, unknown or other
  modified_base (428)..(428): a, c, t, g, unknown or other
  modified_base (463)..(463): a, c, t, g, unknown or other
  modified_base (490)..(490): a, c, t, g, unknown or other
  modified_base (496)..(496): a, c, t, g, unknown or other
  modified_base (526)..(526): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccggggganacttggtccagcctgggagggtccctgagactctcctgtgtcgcctctggattcaccatcagtgaccactatatggactgggtccnccgaggcctccgaggggaaggggctgggagtgggcttcggccganaaagtaaaaacaagtcgacccagtctttancaacagacgtacgccgngtactgtagaaacgtccagtacttcccaccctnacaagagatgaacttcaaagtactcattgatttcngagtaatcgaactaacgagaaaaccgngaacgngatagtagtattagtgttgttacgtattanataacgtagtactcgtacgtacggtcgggacgtacgg

SEQ ID NO: 439112 - DNA, 558 bp, Homo sapiens
  misc_feature: GZ8MTXP02I6IL3.44.36.D03.1.454.CMB.2.raw
  modified_base (223)..(223): a, c, t, g, unknown or other
  modified_base (268)..(268): a, c, t, g, unknown or other
  modified_base (404)..(404): a, c, t, g, unknown or other
  modified_base (440)..(440): a, c, t, g, unknown or other
  modified_base (458)..(458): a, c, t, g, unknown or other
  modified_base (497)..(497): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagctctcctgtgtcgcctntggattcaccatcagtcgaccactatatggactcgggtcccgccgaggcctccggaaggggaaggggctagggagtggcgttggccgacgaaagtaaaaacaagttcgaccagtctttagcacagacgtacgccgngtctgtagaaacgccaagcttccaccctctacaagngatgacttcaaagtactnattgattcagacgtaatcgaactaaccgagaaaacccgnggacacgggctaagttagttatagtttgtgttgttagtttacagtcgaaggtactgtaccg

SEQ ID NO: 439113 - DNA, 769 bp, Homo sapiens
  misc_feature: GZ8MTXP02G7S5W.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgctaggttgggtggaggtccgggggagtacgttggtccagccgtgggacggtccctgagtactctctgtcgtccgccgtcggtacttccactatcagtcgacctactatagtggacgtcgggtcccgccgacggtccgtaccggaagggggaacggggtccgtaggggacgggttcgggtccgttacggggaccccgtaacgtaaaaacggttaaaaaaaccgtaaaggtttcgaacccgttaagttaccctttttaaacgaccgtaaacgtaaagggtaaaccggttacccggtccccggtcgttaccgttaggtaaacggaaaaaccggtccctaaaggttacccttaacccctaacccccgttagttaacccgaaaaggtacgtaaacttaccgttaaaaccgtttacaaaacggttaacctcttaaagttgtactttacgtacgacgtaaacttacggaaacccttaaacgtaacgggaaaaccggacgtacgaacggatagttagttatttagttgttagtttcgtaagtttaagactacgtaaggtacttcggtacacggg

SEQ ID NO: 439114 - DNA, 786 bp, Homo sapiens
  misc_feature: GZ8MTXP02JZM6O.44.36.D03.1.454.CMB.2.raw
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagcgttgggttttccttgttgtttatttacaaggtgtccagagtgaagtgctagttggttggaggtccgggggagtacgttggtccaggccgtgggacggtccctgagactctccgtgtcgtcgctcgtgacttcacatcagtcgacctactatagtggaccgtcgggtccgccgaggcctaccgggaagggggaacggggcgtagggaggtcgggtcgttcggggaccaccgtaaaaggtaaaaaactaggttcgacctagttacttttacacgtaacgaggtacgtaaccggccgtacgttccgtagtaacgaaaccgcccaagtacctttcccacccgttactaacgaaaggtactacgttacgtaaacctttacgaaaacgtaccttactaaagtttcggtaaatttccgtaacggtaaccgtaaagttaccggtaaaacctttaaaacccggaaaacgggaaaaaacccgggtacggggaaaaccgggaccgggggtaaaccttaaaggttttacggttttaaacgttttaaggttttcggtttaaggttttaacggttttaacggtttttaaactacggtttaccggaaacgggtttaaaacccggttcggtttaaacccccgggg

SEQ ID NO: 439115 - DNA, 581 bp, Homo sapiens
  misc_feature: GZ8MTXP02IHREI.44.36.D03.1.454.CMB.2.raw
  modified_base (203)..(203): a, c, t, g, unknown or other
  modified_base (226)..(226): a, c, t, g, unknown or other
  modified_base (260)..(260): a, c, t, g, unknown or other
tcagacagtatatacacgaccggtgctcgatttagctgcgtcacgatctctcttggggttcaactgtggtagagaagacaggattcaggacactctgcagcatggccggcttccctctcctcctcaccctcctcactcactgtgcagggtcctgggcccagtctgttttgactcagccaccctcaacgtctcgggaccccggnagagggtcatcatctcttgttcnggagcagttccaacatcggccctaattctgtatnttggaccagcaagtcccaggaaccgcccccaaactcctcatctataggactaatcagcggccctcgacggggtccctgaccgtattctccgtggcctaccaagtctcggccaccgtcacgccctccctgggcccaagtccacgtcgggccccggtaccgaggacgaggttgacttactacgtgcgcgagtcgttaggactcggacccgcgtggacgggcttggcgttggttcggcggacgggaccaaacgtcgacccgtcgtacggtcacgacccgaaggccgtcgcccccgtcgtcaccgtccgtccgttccccgtcccg

SEQ ID NO: 439116 - DNA, 676 bp, Homo sapiens
  misc_feature: GZ8MTXP02IZ8ZK.44.36.D03.1.454.CMB.2.raw
  modified_base (219)..(219): a, c, t, g, unknown or other
  modified_base (293)..(293): a, c, t, g, unknown or other
  modified_base (372)..(372): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagtctgggttttccttgttgttattttacaaggtgtccagagtgaagtgcagttggtggaggtccggggganacttggtccagcctgggacggtccctgagactctcctgtgtcgcctctggtacttcacatcagtcacactatanggactgggtccgcaggctcgaaggggaggctggagtgcttggaccgacaaagtaaaaataagttcgacctagtctttanctacgagacggtaccgccgtacgttctgtaacgaaacgtcccaaagtacttacccaacccttcgaaacaaggaaagtactacggaacctttaaacgaaaacgtaactactaagtttagtactttacgtaacgaacgtaaagtaccgtaaacctaaaccggtaaacggaaaaaccggacggaaccgggtaaacgtaactaagtttacgtttaaagtttacgtttaggtttacggttttacgttaagtttaactacgtaaggtaacgtacgtacgaccgtacgggaccgggtaacccggtaacggg

SEQ ID NO: 439117 - DNA, 696 bp, Homo sapiens
  misc_feature: GZ8MTXP02IZ7S2.44.36.D03.1.454.CMB.2.raw
  modified_base (270)..(270): a, c, t, g, unknown or other
  modified_base (280)..(280): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtcagagtgaagtgcaggttggtggaggtccgggggagacttgggtccaggcctgggagggtccctgagctctctgtgtcgctntggattcacntcagtcgaccactatagtggacgtgggtcccgccaggcctaccggaggggaacggggcgtgggtagggtcggtccgttcggggaccgacgtaaacggtaaaaaaccaaggttcggaccctaagtccttttacgtacaaccgtaggtaccgtacccggccgtacggttcgtagtacggaaaacgtcctaaacggtactttacccgacccttcctaacgaaaggactatacgtacctttaacaaacgtaaccttcgtaaatttcggtattaccgtgacgtaaacgttacgaaaccgtttaaaaccgaaacggaaaaacccggtaacggaaccggaaccggggtactaaggttacttagtttaagtttgttaggtttaagttacgtttaatacgtactaagggtaccttacggtacccg

SEQ ID NO: 439118 - DNA, 693 bp, Homo sapiens
  misc_feature: GZ8MTXP02G6L0Q.44.36.D03.1.454.CMB.2.raw
  modified_base (279)..(279): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccagccgtggacgggtccctgagctcctccgtgtcgcctctggnttcacatcagtcgaccatatagtggacgtcgggtccgccgaggctccgaggggacgggcgtggggagtcggtcgttgggccgagaaacgtaaaaacgaagttcgacctagtcttatcgacagtacgtaccgccgtcgtcgtgtacgaaacgcccaagtaccttacccaccctctaacgaagatactacgtacctttacgaaacgtaaaccttctaagtttcgtactttaccgtagtaccgtaaaagttccggtaaaaccttaaacccggttaaacggaaaaaacccgggtacgggaaaacccggaccggggtactaacggtttagttaaacgtttagtttaggtttgttttaggtttaacttttaagtaacgttacggtaaacgggttaaccttcgtaacccggtaaccggggg

SEQ ID NO: 439119 - DNA, 752 bp, Homo sapiens
  misc_feature: GZ8MTXP02JODIX.44.36.D03.1.454.CMB.2.raw
  modified_base (223)..(223): a, c, t, g, unknown or other
  modified_base (270)..(270): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagccgtggagggtccctgagactctcctgtgtcgcctntgattcacatcagtgaccactatatggactgggtcccgcaggctccgagggaagggctggagtggcttggccgacaaagtaaaaactaaagttcgccaagtctttagcaacagagtaccgccgtacgtctagtagaaagccctaagacttccgaccccttctacgaaagagatacgtaacctttaacgaaacgtaaaccttcctaaagtttggaactttttacccgtcggtaaacccggtaaaagtttaccggaaaaaccccttttaaaacccccggtaaagggaaaaaaaaaaccccccccgggggtacggggtaaaacccccggtaaaccgggggttaacctttaaaacggttttaaacggtttttaaacgttttaaacggtttttacgggttttaacggttttaaggttttaacgtttttaaaacggttacggtttaaaccggtaaaccggtttaacccggtttacggttaaccccggg

SEQ ID NO: 439120 - DNA, 582 bp, Homo sapiens
  misc_feature: GZ8MTXP02JEH6R.44.36.D03.1.454.CMB.2.raw
  modified_base (313)..(313): a, c, t, g, unknown or other
  modified_base (392)..(392): a, c, t, g, unknown or other
  modified_base (444)..(444): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttcctgttgttattttacaaggtgtccagagtgaagtgcagttggtggaggtccgggggatacgttggtcccaggtcctggacgggtccctgagctctcctgtgtcgctctgattcaccatcagtcgaccactatatggactcgggtccncaggctcggaaggggacggggctgggagtggtcgttcggaccgacgaaagtaaaaacgaagttcgaccctagtctttancaacgtagacgttaccgcgactcgtagtagaaacgccagtacttccaccctntacaaganatgtacttacaagactcaattgaattcgagacgtaatcgtaaactaaccgtaagaaaacccggtaggaccgacgggactagtcgttaattagttgtcgttgttattatacctagaacgtactacgtaccg

SEQ ID NO: 439121 - DNA, 539 bp, Homo sapiens
  misc_feature: GZ8MTXP02I0UY6.44.36.D03.1.454.CMB.2.raw
  modified_base (217)..(217): a, c, t, g, unknown or other
  modified_base (368)..(368): a, c, t, g, unknown or other
  modified_base (377)..(377): a, c, t, g, unknown or other
  modified_base (381)..(381): a, c, t, g, unknown or other
  modified_base (410)..(410): a, c, t, g, unknown or other
  modified_base (433)..(433): a, c, t, g, unknown or other
  modified_base (439)..(439): a, c, t, g, unknown or other
  modified_base (446)..(446): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactggtccgcaggctcgagggagggctggagtggcttggccgcaagtaaaaacaagttcgaccagctttatcacanagtacgccngtcngtgaaagcaagattcaccctgacaaaganatgacttacaaagaactacatanattctntacgaanagataactacgaaacgaagacacgacgatagtattattagtagttgttagttattataacagtaacgtagtacgtacgtacggacgaaccggg

SEQ ID NO: 439122 - DNA, 806 bp, Homo sapiens
  misc_feature: GZ8MTXP02GKNU6.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggacgcctggagtggcttgcacactattcttctacgaatacgaaacaaaactcctaacagtacattctactaggaagacgtactaacgtttaacccatacctaaccgaaaggaacccaacccctaaccgaaaaagggtccgtaagggttcggtttacttttagtaacgtacgaaacccaaacgtacgttacgggtacccctacgggaccggaaacgaccgacggacctaactaaagttacttacggttacggtcgtaccgggttaaacggggtaaaggttaccggggaaaacgggaaaacgtaaacggtacgttaccgttttaggtttacgttagtttaaacttaagttaaccgtttaccttaaccgtgttacgggtacgtaccggttcgggtaacggggaaaccggtaaaccggtacccggtcccgtaacccgtaccccggttacctacccgtacgtacccgttacccgtacccgaaccggaacccgtacccgtccggttacccggttcccccgtacccgtccgggacccgttcccgaccgtcccgtaccggtaacgcccgtcgtaacccgggttcgggggaacccgaccgacgggcccggtcccgggg

SEQ ID NO: 439123 - DNA, 615 bp, Homo sapiens
  misc_feature: GZ8MTXP02FR2AI.44.36.D03.1.454.CMB.2.raw
  modified_base (342)..(342): a, c, t, g, unknown or other
  modified_base (371)..(371): a, c, t, g, unknown or other
  modified_base (425)..(425): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctgggagggtccctgagactctcctgtgtcgcctctggattcaccatcagtgaccactatatggactgggtccgcaggctccgaggggaggggctggagtggcttgggccganaagtaaaaacaagttcgaccagtctttancaacagagtacgcccgtcgtctggtacgaaacgccaagtacttcccaacccgtntacgaaagagactagaaccttcgaaaagtactacatttgactttcgtagacgtaaatacgaaaccttaaaccgtaaggaaaaacccggaggaaccgacggggactaagttacggttatttagttggtagtttgttacgtttaatagtaacgaacggtaacttcgtacctacggtcggggacctaacgggg

SEQ ID NO: 439124 - DNA, 780 bp, Homo sapiens
  misc_feature: GZ8MTXP02GKGOP.44.36.D03.1.454.CMB.2.raw
  modified_base (275)..(275): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagctgggttttccttgttgttattttacaaggtgtccagagtgaagtgcgaggttggtggaggtccgggggagtacgttggtccagccgtggacgggtccctgacgactctcctgtgtcgctntgatcacatcagtcgacctactatatcggacgtcgggtcccgcgacggcccgtacggggaggggacgggtcggtacggtagggtcggtcggtaccgggaccgtaaaaccgtaaaaacgaaaaacgttagtaccgtaacgtaccgtttaactttacgaccgaaacggtacgggtaaccggtaccccgacccgggttcgttacgttaacgggaaaacgaaacccgtacggtaaacgttacccttaaccccctaccccgtttaactaaacgaaagtaacgtacgtaaccgttaaacctaaaacgtaaacgttaacgttattacgttacgttaccgttacgtacggtaaacttaacgtaaaccgtaaacccgtaaaaccggtaaaacggaaaccggtaacgggaaccggacggtaacttaagtttaagtttaacgtttacggtttaggtttaaggtttaacgtttaagtttaacgtacggttaacggtaacgtacgttacccgtaacgg

SEQ ID NO: 439125 - DNA, 572 bp, Homo sapiens
  misc_feature: GZ8MTXP02FZVS1.44.36.D03.1.454.CMB.2.raw
  modified_base (217)..(217): a, c, t, g, unknown or other
  modified_base (302)..(302): a, c, t, g, unknown or other
  modified_base (338)..(338): a, c, t, g, unknown or other
  modified_base (367)..(367): a, c, t, g, unknown or other
  modified_base (384)..(384): a, c, t, g, unknown or other
  modified_base (486)..(486): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctctggattcaccatcagtgaccactatatggactgggtccncaggctccgagggagggctggagtggcttggccganaagtaaaaacagttcgacccagtctttancacgagacgtacgccgngtctgtacgaaacgccaagtacttcccaccctctacaagagatgacttacaaagactcattgacttctagacgtaaatcgaacttaaaccagaaaaacccgnggaaccacgggactaatgttattagttgtcgtttgtagtttatagtcgaaggtaactcggtaccacggttcggggacctaacgggg

SEQ ID NO: 439126 - DNA, 701 bp, Homo sapiens
  misc_feature: GZ8MTXP02JZHFF.44.36.D03.1.454.CMB.2.raw
  modified_base (277)..(277): a, c, t, g, unknown or other
  modified_base (317)..(317): a, c, t, g, unknown or other
  modified_base (397)..(397): a, c, t, g, unknown or other
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagtctgggttttcctgttgttatttacaaggtgtccagagtgaagtgcagttggtggaggtccgggggagacgttgggtcccaggccgtgggacgggtccctgagactctcctgtgtcgctcnggatcacatcagtcgaccatatagtggacgtcgggtcccnccgaggcctccggaaggggaggggcgtgggaggtggcgttgggccgacgtaaagtaaaaacagttcgacctagtctttanacacgtaacggacgtaccgcccggtacgttcgtggtaaggaaaacgccctaagtaccttacccaacccctccgtaacgaaacggagtacgtacggtaaacccttagaaaacgtactactaagtttaggtaactttcgtacggtaaccggtaaaattacgaaacccgttaaaacccgaaagggaaaaaaccccggtcgggaaaacccgacggggaacttaagttacgtttaaacgtttagttcggtttaggtttaagtttaagtttttaacagttaccgtaaagggttaacctcggtaaccccgg

SEQ ID NO: 439127 - DNA, 730 bp, Homo sapiens
  misc_feature: GZ8MTXP02H1DAL.44.36.D03.1.454.CMB.2.raw
  modified_base (273)..(273): a, c, t, g, unknown or other
  modified_base (437)..(437): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcgagttggtggaggtccgggggagtacttgggtccagcctgggagggtccctgagctctcctgtgtcgctcnggacttcaccatcagtcaccactatagtcggacgtcgggtccgccgaggcctaccggaggggaacggggcgtgggaggtggtcgttcgggaccgacgtaaaaggtaaaaaaccaaaggttcgacctaaggttcttttacacaaacgtagaccgtaccggcccgnggttaccttaggagaaaacggccctaagtaacctttacccgaacccgttcccttaagaaagggtactagtacgtaaaccctttacgaaaacgtaaacctttacttaagtttagtacttacgtaggtaacggtaaacttaaccggtaaaacccgtttaaacccggaaaacgggaaaaacccgggtacgggaaacccgaacgggtaacttaagttaaggtttactttacgtttttggttaggttttaagtttaacgttttaatacttacgggtaaacgttacgttaccggtaccg

SEQ ID NO: 439128 - DNA, 579 bp, Homo sapiens
  misc_feature: GZ8MTXP02JM99N.44.36.D03.1.454.CMB.2.raw
  modified_base (373)..(373): a, c, t, g, unknown or other
  modified_base (378)..(378): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgcttattttagaaggtgtccactgtgaggtgcggctgggtggagtcgtgggggaggcgttgggacgagggccgggggggtccctggagctcgtcctgtgcagcctcgtggatcatcttcagtgactatcgaccagtgaacgtcggtcccgcgaggcctcggaggggacgggctgggaggttggtttaccattagtagttaatntgcgnggagtactaccacctactacgcaaggtctcgtaggtacgaacgggcctattcaacctaattcccgagggaacaagtcgacccaaagaccttacgacttagtactcgtaaaggaaactgaacacggctagaacggagacgaggaccacggtctacggtctaactttcgaagttacgagacgtcggtccggtacctagttcgg

SEQ ID NO: 439129 - DNA, 725 bp, Homo sapiens
  misc_feature: GZ8MTXP02JZ1VL.44.36.D03.1.454.CMB.2.raw
  modified_base (318)..(318): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccccagggacggccctggagtggcttgcacacatcttctcgaatgaacgaaaatcctacagtacatctctagaagagctagtttaaccatctaccaaggaccacctaccaaaggcaggtgtctttanatcgacaacatcggaccctgcggacaccgaggcaacattatactgtcgacgacggggtaaatgggaaccgggaaaaagaaacgacgtaccgttaggttttaccgttagttaatttaaataacgttcttaaccattaccgttagggtaccgttacggtcgggggtaaacgaaaacccgggggcccgtacgggtacctaaccccgggttcctacccgtccgaacgtccctttacccgaacccggtaaacccggggtcccctaacggttccccggttacccccgtttccccccggtcgggtccccgtcccccggttcgaccccgttcccggaaacgggcccggttacccccgaaccggtttcccggggaccgggggtacccgtaaccccgggtcgggtcccccccggggg

SEQ ID NO: 439130 - DNA, 549 bp, Homo sapiens
  misc_feature: GZ8MTXP02FNILH.44.36.D03.1.454.CMB.2.raw
  modified_base (376)..(376): a, c, t, g, unknown or other
  modified_base (379)..(379): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggaggtccctgagactctcctgtgtcgctctggattcaccatcagtgaccactatatggactggggtccgcaggcctccgaggggaaggggctggggagtggcttggccgccagtaaaaacaagttgaccagcttttancanagagtacgccgcgtctgtagaaacgccaagtacttcccacccctctacaaagagatcgaacttcaaagaactcattagattctgacgaaatcgaactaaccgtagaaaaccggaggacacgggacagtagtattatgttgttgtgtttactatacaaggactcgtacccg

SEQ ID NO: 439131 - DNA, 743 bp, Homo sapiens
  misc_feature: GZ8MTXP02I8L75.44.36.D03.1.454.CMB.2.raw
  modified_base (217)..(217): a, c, t, g, unknown or other
  modified_base (303)..(303): a, c, t, g, unknown or other
  modified_base (370)..(370): a, c, t, g, unknown or other
  modified_base (375)..(375): a, c, t, g, unknown or other
  modified_base (592)..(592): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggagggtccctgagctctcctgtgtcgcctctggattcaccatcagtcgaccactatatggactgggtccncaggctcgagggaggctggagtggcttggcccgacaagtaaaaacgaagttcgaccagtcttttaancaacngacggtaccgccggtcgttctaggtacgaaaaggtccccaaagtactttaccccgacccccttattaacccgaaaaggtaggaactttcgggaaacccttttaaaccggaaaacgtaaacctttcctaaagtttacggtaactttttccgaggtaaaccggtaaaattaccgggtaaaaccctttaaaccccggaaaacgggaaaaaaaacccccgngggggaaacccccgaacgggggtactaaacggttacggtttaaaagttttattaggggtttaccgttttgttaaagggtttttaaccctaatccggtaaaaggtaaccttggtaccccctaacgggttcgggggaccccgtaaaacggggg

SEQ ID NO: 439132 - DNA, 614 bp, Homo sapiens
  misc_feature: GZ8MTXP02GRIR2.44.36.D03.1.454.CMB.2.raw
  modified_base (226)..(226): a, c, t, g, unknown or other
  modified_base (292)..(292): a, c, t, g, unknown or other
  modified_base (300)..(300): a, c, t, g, unknown or other
  modified_base (338)..(338): a, c, t, g, unknown or other
  modified_base (351)..(351): a, c, t, g, unknown or other
  modified_base (378)..(378): a, c, t, g, unknown or other
  modified_base (426)..(426): a, c, t, g, unknown or other
  modified_base (460)..(460): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacgaaggtgtccagagtgaagtgcagttggtggaggtccggggganacgttggtccaggcctggagggtccctggagactctcctgtgtcgcctctggattcaccatcagtnaccactanagtgacgtggtccgcaggctaccgaggggagggctggngtggctggccganaaagtaaaaacaagtgacagtctttancacagagtacgcgcgtctgtagaaaacgcctaagcttacccacccctntacaaagagatcgaaaccttagaaaataaccttntagttagacttgagacgtaatacgtaaacctaaaacgtaaacgaaaaaccggacggaaaccgaagggtactaagttacggtttaaatttagtttggtttagtttaagtttaagttttaaagaccgttacggtaaagtaccgttacggtaacccg

SEQ ID NO: 439133 - DNA, 746 bp, Homo sapiens
  misc_feature: GZ8MTXP02G24BC.44.36.D03.1.454.CMB.2.raw
  modified_base (267)..(267): a, c, t, g, unknown or other
  modified_base (559)..(559): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggagtccgggggatacttggtccagcctggagggtccctgagactctctgtgtcgcctntggacttcacatcagtcgaacctactatagtcggacgtcgggtcccgccgaggtccgtaccggaagggggaacggggtcgtaggggtacggtcgggtccgttcggggacccgtaaccgaaaacggttaaaaaacgtaaaggttccgaccgtaagttcgtttactaccgaacgtaggaaccgtaccgcccgtacggttcctaagggtacgaaaacggccctaaggttaaccttcccctaaccccgttgtacaaaagggataacgtcgtaaacctttacgaaaaacgtaccttnttaagtttaggtaccttagttacggaccgttaaaattaccggaaaccgttaaaacccgtaaggggaaaaaacccccggtggaaacccggtaaacggggacttaaagttacggtttaaattttacggtggttttaagtttgtttaggttttaatacgtaacggtacggtttaaacgttccgtaaccgg

SEQ ID NO: 439134 - DNA, 543 bp, Homo sapiens
  misc_feature: GZ8MTXP02HRGT9.44.36.D03.1.454.CMB.2.raw
  modified_base (208)..(208): a, c, t, g, unknown or other
  modified_base (221)..(221): a, c, t, g, unknown or other
  modified_base (261)..(261): a, c, t, g, unknown or other
  modified_base (292)..(292): a, c, t, g, unknown or other
  modified_base (305)..(305): a, c, t, g, unknown or other
  modified_base (365)..(365): a, c, t, g, unknown or other
  modified_base (378)..(378): a, c, t, g, unknown or other
  modified_base (385)..(385): a, c, t, g, unknown or other
  modified_base (410)..(410): a, c, t, g, unknown or other
  modified_base (416)..(416): a, c, t, g, unknown or other
  modified_base (426)..(426): a, c, t, g, unknown or other
  modified_base (435)..(435): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggnggagtccgggganacttggtccagcctggagggtccctgagactctctgtgcncctctggattcaccatcagtgaccactatanggactggggcccncaggcctcgagggagggctggagtggctggccgacaagtaaaaacagtgaccagctttancaacagacgtacnccgatcngtagaaagccagattccacctctanaaaggnatacgactanaaagtactnattagacttcgagactatacgaacctaacgtaacgaaaaccgcgacgacggactagtacgttattagttcgtagttaagttattaacgtatacgtacgtacttcgacg

SEQ ID NO: 439135 - DNA, 616 bp, Homo sapiens
  misc_feature: GZ8MTXP02IFC12.44.36.D03.1.454.CMB.2.raw
  modified_base (218)..(218): a, c, t, g, unknown or other
  modified_base (302)..(302): a, c, t, g, unknown or other
  modified_base (373)..(373): a, c, t, g, unknown or other
  modified_base (414)..(414): a, c, t, g, unknown or other
  modified_base (435)..(435): a, c, t, g, unknown or other
  modified_base (520)..(520): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacttggtccagcctgggaggtccctgagactctcctgtgtcgcctctggattcaccatcagtgaccatatatggactgggtccnccaggcctcgaggggaagggctgggagtggcttggccgagaagtaaaaaacagttcgaccctagtctttanactaacagtacgtaccgccgtcgttacgtgtacggaaaacncccaagtactccctaaccctntacaaacgtagaacttgaaccttacgaaaagtaactctaattgattttcaggcaaagtcgaaacctaaactaaggaaaaacccgngaaccgacgggactaatgttatttaattggtagtttgttagttttaacagtaacgaggtaaactcggtacctacggtcggggaacccgaaccgggg

SEQ ID NO: 439136 - DNA, 733 bp, Homo sapiens
  misc_feature: GZ8MTXP02JU09M.44.36.D03.1.454.CMB.2.raw
  modified_base (223)..(223): a, c, t, g, unknown or other
  modified_base (399)..(399): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgcagttggtggaggtccggggganacgttggtccaggccgtgggacgggtccctgacgactctcctgtcgtcgcctctggattcaccatcagtcgacctactatatggacgtcgggtccgccgaggcctaccggaggggaacggggctgggagtggcgttgggccgacgaaacgtaaaaacaagttcgaccagtctttancgaactaggacgtaccgccgtacgttcgtagtacgaaacgccctaagtacttcccacccctctacgaaagtacgtatacggtaaccttaacgaaacgtaacctcgtaagtttacggtaactttcgtacggtaaccgtaaaacgttaccggtaaaacccttaaaaccccgtaaaacgggaaaaaaccccgggtaacggggaaacccggaaccgggggtaccttaaacggtttacggttaaaccgttttaaggtttaggttttacggtttaaggtttacggtttttaaattaacgttaaccggtaaacggggttaaaccgtttcggtaacccccgg

SEQ ID NO: 439137 - DNA, 739 bp, Homo sapiens
  misc_feature: GZ8MTXP02FSGN8.44.36.D03.1.454.CMB.2.raw
  modified_base (285)..(285): a, c, t, g, unknown or other
  modified_base (331)..(331): a, c, t, g, unknown or other
  modified_base (428)..(428): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacaaggtgtccagagtgaagtgctaggttggtggaggtccgggggatacgttcggtccaggccgtgggacggtccctgacgtctctccgtgtcgtccgtcctntggattccacctatcagtcgacctactatagtggacgtcgggtccncgacggctccggaggggaacgggtctagggtgtggtcgttacggaccgaacgtaaaacggtaaaaacctaaggttcgaaccgtaggttaccttttanaccgaacgtaaggtaccgtacccgccgtcggtactaggtaagaaaaccgccgaaagttccctacccacccgtataacgaagatacgtacgtaaacttaaccaaaggtacttacgtagtttacgtacttaccgagtaaaccgttaggtaaacctaaaccccgtttaaacggaaaacccgggaaaaccgaacgggacccggtaaggggtacttaaaggtttacgtttaagtttacgttaccggttttaggttaaccggttttaaggtttaactaacggttacgtaacggtaaccgtttcggttaaccccgggg

SEQ ID NO: 439138 - DNA, 687 bp, Homo sapiens
  misc_feature: GZ8MTXP02FS6JY.44.36.D03.1.454.CMB.2.raw
  modified_base (327)..(327): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtggaggtccgggggagacgttggtccagccgtgggacgggtcccctggacgactctccgtgtcgtccgcctctggacttcaccatcagtcgaccactatatggacgtcgggtcccnccgaggtccgtaccggaagggggaacggggtcgtaggggacggtcggggccgtttacggggacccgaaccgtaaaaacgtaaaaaaccgtaaacggttcgaccgtaagttctttagcaacgtagacgtaccgccgtcgtacgtgtaacgaaacgccaagttccttacccgacccctactaacgaaagtacgacgttacgtaaaccttaacaaagtaacccttattacgttagtacttccgagtagtaaactacgtaaaccgtaaaccgtaaacgggaaaaccggacggaaccgacggtactaagttagttattacgttgttagttgttagttaatacgtcgaaaggtacctggttaccgg

SEQ ID NO: 439139 - DNA, 582 bp, Homo sapiens
  misc_feature: GZ8MTXP02H5HZ4.44.36.D03.1.454.CMB.2.raw
  modified_base (210)..(210): a, c, t, g, unknown or other
  modified_base (224)..(224): a, c, t, g, unknown or other
  modified_base (273)..(273): a, c, t, g, unknown or other
  modified_base (382)..(382): a, c, t, g, unknown or other
  modified_base (470)..(470): a, c, t, g, unknown or other
  modified_base (502)..(502): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggnggagtccggggganacgttggtccagccgtgggacgggtcctgagctctcctgtgtcgcctcnggattcaccatcagtgaccactatatggacctgggtcccgcaggcctccgagggaggggctggagtggcttggccgacgaaagtaaaaccaagttcgaccagtctttancacaggtagtaccgcgctcagtacgaaacgccaagtcttccacccgtctacaagacgatgaacttaccaaagactctattgatttcgngacaaagtcaaccttaaactaagaaaacccgngggaaccaggggactagtgttaactttagttggtttagttaagttagttttaatacgtcgaaggtaactcggttaacccg

SEQ ID NO: 439140 - DNA, 706 bp, Homo sapiens
  misc_feature: GZ8MTXP02IFXID.44.36.D03.1.454.CMB.2.raw
  modified_base (279)..(279): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagcttgggttttcttgttgttattttacaaggtgtccagagtgaagtgcgtaggtttggtggaggtccgggggagtacgttggtccagtccgtggacgggtccctggagctctcctgtgtcgcctntgattcacatcagtcgacctactatagtggacgttcgggtcccgccgaggcctacccggaagggggtaacggggtccgtaggggaggttcgggcgtttcgggacccgtacgaaaaacgttaaaaaacgtaaaggttcgaccctaaggttacctttttacgcaaacgacggtaacggtcccgccggtcgtacgtagtaagaaaccgccctaagtaccttcccaaccccttctaacgaaagtacgtaatcgaaacctttaacgaaaacgttacttcctatttacgggaatttccgaggaaccgtaaagttacggaaaccctttaaaacgaaacggaaaaacccggaggaaaccgaccgggaactagttagttaatttacgttgttgggtttaacgttagtttaatacgtagaacggttaactcgtaccg

SEQ ID NO: 439141 - DNA, 632 bp, Homo sapiens
  misc_feature: GZ8MTXP02IUUL6.44.36.D03.1.454.CMB.2.raw
  modified_base (289)..(289): a, c, t, g, unknown or other
  modified_base (392)..(392): a, c, t, g, unknown or other
  modified_base (495)..(495): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtggaggtccgggggagtacgttggtccaggccgtgggacgggtccctgagactctcctgtgtcgctctgattcaccntcagtcgaccactatagtggacgtcgggtccgccgaggcctccggaggggagggctgggagtggcttggccgacgaaagtaaaacagttgacctagtctttancacgagacgtaccgcgtcgtctgtagaaacgccaagtcttacccgaccttcctacgaaagagtatcgaactttacgaaagtaacttctaatttgaacttccgngtaacgtaagtacgtaaaccttaaaccgtaacgggaaaaacccgcggaaaccgacggggtactaaattaggttactttaagttggtttagtttgtttacgtttaatacgtacgtaacggttaacgttcgtaacccgg

SEQ ID NO: 439142 - DNA, 613 bp, Homo sapiens
  misc_feature: GZ8MTXP02HVX4F.44.36.D03.1.454.CMB.2.raw
  modified_base (304)..(304): a, c, t, g, unknown or other
  modified_base (315)..(315): a, c, t, g, unknown or other
  modified_base (376)..(376): a, c, t, g, unknown or other
  modified_base (393)..(393): a, c, t, g, unknown or other
  modified_base (421)..(421): a, c, t, g, unknown or other
  modified_base (429)..(429): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcagttggtggaggtccgggggatacgttggtccagccgtgggacgggtccctgagactctcctgtgtccgcctctggattcaccatcagtgaccactatanggactgggccncaggctccgaggggagggctggagtgcgtggccacgaagtaaaaacagtgacagtctttancaacagacgtacgccgngtctgtagaaagccagtactccaccctntacaaganagtagacttacgaaagtacttacattagattcgtacggacgtaaagtcgtaaaccttaaaccgtaacggaaaaacccgagggtaacccgacggggacctaagttagttaaactttagttaggtttagtttaaggttagttttaaagtacttaaccggtacgggtaacctttacggtacccccgg

SEQ ID NO: 439143 - DNA, 629 bp, Homo sapiens
  misc_feature: GZ8MTXP02IRB10.44.36.D03.1.454.CMB.2.raw
  modified_base (323)..(323): a, c, t, g, unknown or other
  modified_base (453)..(453): a, c, t, g, unknown or other
  modified_base (547)..(547): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggtttccttgttgttattttacaaggtgtccagagtgaagtgcaggttggtggaggtccgggggatacgttgggtccaggccgtgggacgggttccctggacgactctcctgtgtcgcctctggattcaccatcagtcgaccactatagtggacgtgggtcccnccgaggcctccggaggggaacggggctgggaggtggcgttggccgacaaagtaaaacaagttcgaccagtctttagcaacaggacgtaccgccgacgttctagtagaaacgccaagtacttccacccctntacaaagacgatgtaaccttacaaacgtaaccttctaatttggaactttccgtaggacgtaatacgtaaccttaaaaccgaggaaaaacccggnggaaccgacgggactagtaggttactttaagttgttagtttaagttagtttaactacgtacgtacggtaaacttgtaacccg

SEQ ID NO: 439144 - DNA, 562 bp, Homo sapiens
  misc_feature: GZ8MTXP02FGDSP.44.36.D03.1.454.CMB.2.raw
  modified_base (204)..(204): a, c, t, g, unknown or other
  modified_base (257)..(257): a, c, t, g, unknown or other
  modified_base (304)..(304): a, c, t, g, unknown or other
  modified_base (326)..(326): a, c, t, g, unknown or other
  modified_base (450)..(450): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgtcgttgggttttccttgttgcttatttagaaggtgtccatgtgagtgcggntggtggagtcgtgggggagcttggtacgagggcggggggtcctgagactctcngtgcagcctctggattcatcttcagtgactatgctatgactggtccncgaggctccgaggggagggtcnggtagttggttccattatagttaatattgctggagactaccacctactacgcagactcgtgtagaaacggggccctattccaaacctaagttcccgagggaccaagtcgaccaaagtaaccctnaacttggtatccgtaaggaaaattcgaaacacgccgtagaagacggaacggtaggaccacggtctcgtactacttccgtgttacgagacgtccgtcgggaccctggtttcgg

SEQ ID NO: 439145 - DNA, 712 bp, Homo sapiens
  misc_feature: GZ8MTXP02HLPP8.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcccgtggagtgggcttgcacacatcttctacgaatagaacgaaaatcctaacagtacatctactagaagagactagtttaaccatctaccaacgacacctacaaaaggctaggtgtacttagtactacgaccaacgagtacggaccctgaccggacacgacgacactattactacgtgtcgacgtaagggtaactagggaacgggaaaagaaacgtagtcgttaggtttactagttaaattaacttaacgttacttaccagttcgtagggacgtcgtacggggaaacgaaacggggtacccgtacgtaccgtacccggttcctacccgtagtacccgtccctttaacccgaacccgtaaccggggtcccctaaccggtttccccgggttcccccgtttcccccgggttacgggccccgtcccccggttcgcccgtttaacccggacggtaaccggcccgtaacccggtccggggtacgggggaccctaaccggcggggtcccccgggg

SEQ ID NO: 439146 - DNA, 598 bp, Homo sapiens
  misc_feature: GZ8MTXP02I0OD5.44.36.D03.1.454.CMB.2.raw
  modified_base (222)..(222): a, c, t, g, unknown or other
  modified_base (465)..(465): a, c, t, g, unknown or other
  modified_base (489)..(489): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggtttccttgttgttatttacaaggtgtcagagtgaagtgcaggttggtggaggtccggggganacgttggtccagccgtggaggtccctgagactctccgtgtgtcgctctggactcaccatcagtcgaccactatagtggacgtcgggtcccgcgacggcctccggaggggaagggctgggagtggcgtggccgacaaagtaaaaaccgaagttcgacctaagtctttatacgaacaggacgtaccgccggtcgttctagtacgaaaggcccaagtactttcccacccttctaacaaagacgtangtaaccttacaaagtaaacccttntatgtactcgagactaactacgtaaacctaacgaacgaaaccgagacgacgactagtataagttagttgttgttaagttagttaactacgtacgaacgtcgtacgtacg

SEQ ID NO: 439147 - DNA, 586 bp, Homo sapiens
  misc_feature: GZ8MTXP02FF8UG.44.36.D03.1.454.CMB.2.raw
  modified_base (223)..(223): a, c, t, g, unknown or other
  modified_base (309)..(309): a, c, t, g, unknown or other
  modified_base (385)..(385): a, c, t, g, unknown or other
  modified_base (436)..(436): a, c, t, g, unknown or other
  modified_base (444)..(444): a, c, t, g, unknown or other
  modified_base (463)..(463): a, c, t, g, unknown or other
  modified_base (507)..(507): a, c, t, g, unknown or other
  modified_base (560)..(560): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccggggganacttggtccagcctggaggtccctgagactctcctgtgtcgctctggatcaccatcagtcgaccactatagtggactcgggtcccnccaggcctccgaaggggaaggggctgggagtggcttcgggccgacaaagtaaaaaacaagttcgaccagtctttancaacgagacgtaccgcgcgtctgtagaaacgccaagtacttcccacccctntacaaagnatgaacttcaaaagtactntattgatttcagactaatcgaaacctaacgtaagaaaaacccgnggaaaccgacgggtacagttacgtaatttagttgttagttgttagttttaaanacgtacgtaacggtacctcggtaccg

SEQ ID NO: 439148 - DNA, 808 bp, Homo sapiens
  misc_feature: GZ8MTXP02JN3Z1.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcaggttggtgggaggtccgggggagacgttggtccgaggccgtgggacgggtccctggacgactctccgtggtcgtccgtcctcgtggacttccaccgatcgagtacgaaccactatagtcggacgtcgggtcccgccgacggccgtaccggaagggggacggggctggggagtcggggtcgttcggggaccgaacgtaaaaggttaaaaaacgaaacggtttacgacccgtaagttactttactaccgtaacgaacggtacgtaacccggtccgtcggttacgttaggaaacgaaaccgccctaagtacctttaccccgaccctctaacgaaagtagaagtacgtaaaccctttaacgaaaacttaaccttacgtaagtttacgttaatttacccggtagaaacggttaaacgtttaacgaaaacccccgtttaaaacccggtaaaacggaaaaaaccccgggttaacggggaaaaccgtacccgggggtaaacttaaagttacggttttaaaacttttaaggtttgtttagggtttaaggttttaaatttttaaccggaacgtttaacgtaaacggttaaaccccgtttggttaaaacccccggg

SEQ ID NO: 439149 - DNA, 560 bp, Homo sapiens
  misc_feature: GZ8MTXP02HV0MT.44.36.D03.1.454.CMB.2.raw
  modified_base (190)..(190): a, c, t, g, unknown or other
  modified_base (221)..(221): a, c, t, g, unknown or other
  modified_base (233)..(233): a, c, t, g, unknown or other
  modified_base (269)..(269): a, c, t, g, unknown or other
  modified_base (381)..(381): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctcgtgtctggtcncctggacagtcgtcacatctcctgcatgganccagcggtaatnttcttagtcttaactttgtctcctggtatcaactancatccaaggtaacgccccaaactcatcatctatgagcctataacgagccctacgaggggtttctaactcgcttcactcgccctcacgtccggacaaccgccggccctcccgngacaactctccgtcgggacctcccgaggtctacggacggacgacggcctagtactttatttagttgtttcgctcgagtagttgtcgttcgactatcctactttagtcgtcgtttacggagtacggacctaggtcctaccgtcgtaacgtcgacacccgacgaccccaaccctacgtccg

SEQ ID NO: 439150 - DNA, 922 bp, Homo sapiens
  misc_feature: GZ8MTXP02FN79D.44.36.D03.1.454.CMB.2.raw
  modified_base (211)..(211): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggnggaggtccgggggatacgttggtccagccgtgggacgggtccctgagactctcctgtcgtcgctctggtattccacatcagtcgacctaactatagtgggaccgtggggtccccgaccgaggtcccgtaccggaaggggggtaacgggggtccttagggggacggtttcggggccgtttacgggggaccccgtaaccgtaaaaacgggttaaaaaaaaccgtaaaggtttccggaaccccgtaaaggtttaccctttttacgaccctaaacggtaaacgggttaaaccgggttaccccggtacccgggtacggtttacccgtaagggggttaaaccgaaaaaacggtcccccgtaaaggttaacccttttaccccaaaccccctttccgtaaagtaaaacggaggtaacttacggttaaaccctttacgtaaacggtaaacccttgttaacgtttagtaacctttccgagggtaacccgtaaatttaccgggaaaaccctttaaaccccgggtaaaacggggaaaaaaaacccccgggggtcggggaaaacccgggtaaccggggtaactttaaaacgggtttaacggttttaaacgtttttaaacgggtttccgggttttaaggtttttaacgggtttttaaacgtttttaaacgtaacgggtttaaccggttaaaacgggtttacccggtttaccgggtttaaacccgg

SEQ ID NO: 439151 - DNA, 639 bp, Homo sapiens
  misc_feature: GZ8MTXP02JX4NU.44.36.D03.1.454.CMB.2.raw
  modified_base (292)..(292): a, c, t, g, unknown or other
  modified_base (408)..(408): a, c, t, g, unknown or other
  modified_base (430)..(430): a, c, t, g, unknown or other
  modified_base (472)..(472): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtgggaggtccgggggagacgttggtccaggccgtgggacgggtccctgacgactctccgtgtgtcgcctctggattccaccntcagtcgaccactatagtggacgtcgggtcccgccgaggcctccggaaggggaacggggtcgtgggaggtggcgttcgggccgacaaacgtaaaaactaagttgactagtctttancaacgagacgtcgccgtcgtcngtaagaaacgccagtacttcccgacccttacaacaaaacgtntacgtaaccttacgaaacgtactacgtagttagtacttcacgtaacgtaatacgtaaacctaaaccgaacggaaaaccggcggaaccgacggtactagttagttaagtttacgttggttgtttagttgtttaactacgtacggtaacgtacgttccgtacgtacggg

SEQ ID NO: 439152 - DNA, 591 bp, Homo sapiens
  misc_feature: GZ8MTXP02HFLHL.44.36.D03.1.454.CMB.2.raw
  modified_base (290)..(290): a, c, t, g, unknown or other
  modified_base (319)..(319): a, c, t, g, unknown or other
  modified_base (432)..(432): a, c, t, g, unknown or other
  modified_base (467)..(467): a, c, t, g, unknown or other
  modified_base (474)..(474): a, c, t, g, unknown or other
  modified_base (485)..(485): a, c, t, g, unknown or other
  modified_base (489)..(489): a, c, t, g, unknown or other
  modified_base (493)..(493): a, c, t, g, unknown or other
  modified_base (529)..(529): a, c, t, g, unknown or other
  modified_base (534)..(534): a, c, t, g, unknown or other
tcagacagtatatacacgaccggtgctcgatttagctgcgtcacgatctctcttgggggagctctgagagcggagccccagccccagaattcccaggtgttttcatttggtgatcagcactgaacacagaggactcaccatggagttcgggctgagcttgggttttccttgttgttattttacaaggtgtcagagtgaagtgcaggttgggtggaggtccgggggatacgttgggtccaggccgtgggacgggtccctgagctctcctgtgtccgcctctggactcaccntcagtcaccatatagtggactcgggtccnccgaggcctaccggaggggaacggggctgggaggtggcgttcggggaccaaccgtaaaagtaaaaaaccaaggttcgaccgtaagtctttagctaagacgacgtaccgcccgngtcctagtacgaaacgtccaagtactcccaccctnacaaagnatgactgaaanactntatntatcgagactaatacgaaactaacgaacgaaaacgngacgngatagtagttattagtgttagttaacgttattaacacgtacgtaacgtactcgtacg

SEQ ID NO: 439153 - DNA, 610 bp, Homo sapiens
  misc_feature: GZ8MTXP02GYLAZ.44.36.D03.1.454.CMB.2.raw
  modified_base (209)..(209): a, c, t, g, unknown or other
  modified_base (316)..(316): a, c, t, g, unknown or other
  modified_base (338)..(338): a, c, t, g, unknown or other
  modified_base (363)..(363): a, c, t, g, unknown or other
  modified_base (372)..(372): a, c, t, g, unknown or other
  modified_base (439)..(439): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcagttggnggaggtccgggggatacgttgggtccagccgtgggacgggtccctggagactctccgtgtgtcgcctgtggattcaccatcagtgaccactatatggactgggtccncgagctcgaggggagggctggngtgctggccacaagtaaaaacagtnacagtcttncacagacgaccgcgcgtcagtagaaacgcagtacttccacccttcacaaagacgatacgtaacttanaaaacgtacttacattagtacttaccgtgaaccgtaaatcggaaacccttaaaaccgaacggaaaaaccccggtaggaaccgtaacgggggactaaagttacgtttacttaacgttggttagtttaaggtttatttaactaagtacggtaaacgtaacttcggtaacccgg

SEQ ID NO: 439154 - DNA, 646 bp, Homo sapiens
  misc_feature: GZ8MTXP02I5HFX.44.36.D03.1.454.CMB.2.raw
  modified_base (387)..(387): a, c, t, g, unknown or other
  modified_base (408)..(408): a, c, t, g, unknown or other
tcagacagtatatacacgaccggtgctcgatttagctgcgtcacgatctctcttggggctgggcctaaggaagcagcactggtggtgcctcagccatggcctggacctttctcctcctcggcctcctctctcactgcacagggtctatgacctcctatgtcctgactcagccaccctcagtctcaggtcggccccgaggggagaccggccaggattaccgtggtgggggcgacgccggttaggaaggtaaagtgtacgagtggtaccagcagaacgcaggaccacgacccctgtgccgtggtcatctattatgatgccggggccgccctcgagtcgactcccgtgccgcgtccttcccgtccggctcccaacgtcgtacggggaacnccgggacccacccgtgacccntcaggccgaggggtcggacggggccggggatcgggaacgggccgaacgttagttaccgtggtacgacggcgttagggtcgggaacgtaggttaggtaggtagtacgtacgtacgttccgggttggtacggttcgggacgggtagggaacccgaggccgttacggtacccgtcggtcggggtaccaccggaccgtaacggccctccgtacccccgtcggtcctaccgtccgtttccccg

SEQ ID NO: 439155 - DNA, 720 bp, Homo sapiens
  misc_feature: GZ8MTXP02JCJOS.44.36.D03.1.454.CMB.2.raw
  modified_base (209)..(209): a, c, t, g, unknown or other
  modified_base (224)..(224): a, c, t, g, unknown or other
  modified_base (279)..(279): a, c, t, g, unknown or other
  modified_base (310)..(310): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtctgggttttccttgttgttattttacaggtgtcagagtgaagtgcagttgggnggaggtccggggganacgttggtccagccgtgggacggtccctgagactctctgtgtcgctctgatcacntcagtcgaccatatagtggacgtcgggcccncgaggtcctaccggaaggggacggggtctagggacggttcgggtaccttggggacccaacgtaaaaggtaaaaaaaccgtaaggtttcgaccccgtaagttaccctttttagaccgaacggaaggtacgtacccggcccgtcgtttaccgaggtacgaaaacgcccaagttactttaccccaaaccccttgaaccgaaaggtatacgtacgttaaacctacgaaaactactacttaagttacgtaacttccgtaacgtaacgttaaacgtaccgtaaaacccgttaaaccggaaacggaaaaccgggtacggaaaccgacggtacttaagtttacgtttagtttacggttggtttaggtttaagtttaaccgtttaatacgtacggaacggtttacctacggttaaccgg

SEQ ID NO: 439156 - DNA, 733 bp, Homo sapiens
  misc_feature: GZ8MTXP02IQPIR.44.36.D03.1.454.CMB.2.raw
  modified_base (328)..(328): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaaggccctggagtggcttgcacacatcttctacgaatgaacgaaaatcctaacagtacatctctagaagagctaagttaaccatcctaccaagaccacctacaaagcaggtgtactttagtatgaccaanatcgacctgcgacacgagcacatacttactgtcgacgtacgggtaaagtacggaacggggaaaacgaaacgaggtacgttagggtttccttagttaactttaagtttaaacgttaccgtttaacctaattcggttacgggtacgttcggttagggggaaaccgtaaacgggggacccgtaccgggttacccgtacccggtttcccgtacccttcgtaaccgtcccgttaaccccgaccgtaaaccgggggtcccctaaccggtttcccggggttacccccttttcccccggtaccggtcccccggtacccccgttccggtacccccgtacccggtaacggtaaccgaccccgtaacccggttcccggggtaccgggggacccaccgggtaaccggtcccccgggg

SEQ ID NO: 439157 - DNA, 710 bp, Homo sapiens
  misc_feature: GZ8MTXP02GO4P8.44.36.D03.1.454.CMB.2.raw
  modified_base (226)..(226): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccattctgccctgactcagcctgcctccgtgtctgggtcgcctggacagtcggtcaccatctcctgcactgganccagcggtaatattcttagtcttaacttgtctcctgtatcacatcatccaagtaacgaccccaatcatcatctatgaggacctaagtaagacggaccctagtacggggtttactaacgtcgtccttacgactcgtaccctaccgacgtcccggacaaaccgaccgtccctaccctgtaacctaactccgttccgtcgggtaccgtccgtacgggtactacgggacggaaccggtagggaccgttaggtaaatttttaacgtttaaagtttcgtttagtcccgtttacgtagggttaactttcggtttacgtcggttactacgttaaccttacgtttattacgtttaccggttaagggttaaacggttaacggggaaacccgtaaaacggggttccctaaacccggtttcccggtaaacgggtttcccgaacggacccccgttaaaaccggggaccccctaaaacccccggttaacttaccccgg

SEQ ID NO: 439158 - DNA, 652 bp, Homo sapiens
  misc_feature: GZ8MTXP02F3KMT.44.36.D03.1.454.CMB.2.raw
  modified_base (188)..(188): a, c, t, g, unknown or other
  modified_base (541)..(541): a, c, t, g, unknown or other
  modified_base (547)..(547): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtgggttttccttgttgttattttacaaggtntccagagtgaagtgctagttggtggaggtccgggggatacgttggtccagccgtggacgggtccctgacgactctcctgtcgtcgtcctcgtggtacttcaccatcagtcgaacctacgtatagtcggacgtcgggtcccgcgacggcctaccggaaggggaacggggtctaggggacggtcgggcgttcggggcccgtaaccgtaaaacggtaaaaaaacctaaaggtttcggacctaaggttcctttagccaacgaagaccgttaaccgcccgtgtctagtacgaaaacgtcccaaagtacttacccgaccctctaacgaaagtatagtcgtaacttaacaaagtaacctntagttnacttcgagacgtaatacgaaacgtaaaccgaacgaaaaccggcgaacgagatagttagttacttagtgttagttcgttagtttacacgtagacgtactcggtacg

SEQ ID NO: 439159 - DNA, 589 bp, Homo sapiens
  misc_feature: GZ8MTXP02I2G9M.44.36.D03.1.454.CMB.2.raw
  modified_base (344)..(344): a, c, t, g, unknown or other
  modified_base (381)..(381): a, c, t, g, unknown or other
  modified_base (396)..(396): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttaaaggtgtccagagtgaagtgcaggttggtggaggtccgggggagtacgttggtccagccgtgggagggtccctgagactctcctgtgtcgcctctggattcaccatcagtgaccactatatggactgggtccgccaggcctccgaggggaggggctggagtggnttcggcgcaagtaaaaacaagttgaccagtactttancacagagtacgccgngtctatgaaagcccagacttccaccctctccaaagagatacgacttacgaaagtaaccttacattgtattactagacaattcgaaaaccttaacctaacggaaaaaccgacggaaccgacggggacctataggttaatttagttaggttgtttgttaacgtttatacgtcaaggtaacttgtacccgttaggg

SEQ ID NO: 439160 - DNA, 694 bp, Homo sapiens
  misc_feature: GZ8MTXP02FQ4N2.44.36.D03.1.454.CMB.2.raw
  modified_base (339)..(339): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatcccgtcacgcccccgagggaacggccctggagtggcttgcacacatcttctacgaatgaacgaaaaatcctaacagtacatctctagaagagactaagtttaacccatcctaccgaaaggaccacctaccaaaggcaggtgttcttagatgaaccaanagtcgacctgacggacacgaggacacattattactgtgacgtaacggggtaaagtcgggaaacggggtaaaaagaaaccgaggtacgttaggttttacttagttaaactttaagttaacgttacttaacccgtatcgttaggtaccgtacggtacgggggtaacggaaacgggacccgtaccgggtaccgtaacccggtaccgtccccttacgaccggttcccttacccgaaccggaaaccggggtccctaacgttcccggtccccttcccccggtacggccccgttaccccgtcgtacccgaccgacggaacgtcccaaccggtcgggtcgggggaccacggaccggtcccggg

SEQ ID NO: 439161 - DNA, 720 bp, Homo sapiens
  misc_feature: GZ8MTXP02GCCQ2.44.36.D03.1.454.CMB.2.raw
  modified_base (326)..(326): a, c, t, g, unknown or other
  modified_base (414)..(414): a, c, t, g, unknown or other
  modified_base (485)..(485): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgctagttggtggaggtccgggggatacgttggtccaggcctgggacgggtccctggagtacctctcccgtgtcgtcgtcctcgtggattccaccatcagtgaccactatagtggacgtgggtcccnccagggcctccggaaggggacggggcgtgggaggtgggccttggggccgacaaaagtaaaaccaaagtttcgacccaagtccttttancctaaacaggtaacgtaccgccgctaaatcgttaggagaaaacggtcccaagtactttacccaaccccttntaacgaaagtagtacgttactaacttaacgaaacgtaacttactaagtttacgtactttacgtacgtaacgtaaacgttaacccgtaaaccttaaaaacccggtaaaagggaaaaaacccggtacgggaaaccgggtaaccgggtacttaaagtttacgtttaaaacgttttgtttaggtttggtttacgttttaaggtttaaacgtaacgtttaacggaaacggttacttccgg

SEQ ID NO: 439162 - DNA, 629 bp, Homo sapiens
  misc_feature: GZ8MTXP02FSQX0.44.36.D03.1.454.CMB.2.raw
  modified_base (315)..(315): a, c, t, g, unknown or other
  modified_base (583)..(583): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttcctgttgttattttacaaggtgtccagagtgaagtgcaggttggtggaggtccgggggagtacgttggtccagccgtgggaggtccctgagactctcctgtgtcgcctctggattcaccatcagtcgaccatatagtggactgggtcccncgacggctacggaggggaacggggctggggagtcggcttcggccgacaaagtaaaaaccaagttcgaccagttctttagcaacgagacgtaccgccgtacgtcgtagtacgaaaacgcccgtaagtacttacccgacccctactacgaaagtacgaattcgaaacctttacgaaacgtactctagtttagacttcgtagacgtaatacgaactaaaccgtacggaaaaccgaggaccctagggactaagttagtactttagttggttnttaaggtttagttaatacgtaccgtaaggtaaccttcgtaacccgg

SEQ ID NO: 439163 - DNA, 777 bp, Homo sapiens
  misc_feature: GZ8MTXP02FNGXS.44.36.D03.1.454.CMB.2.raw
  modified_base (304)..(304): a, c, t, g, unknown or other
  modified_base (349)..(349): a, c, t, g, unknown or other
  modified_base (381)..(381): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatagtcggactgggtccnccgaggcctaccgaggggaagggctgggagtgggcttgggccganaagtaaaaacaaggttcgacccagtactttancaacgagaggtaccgcgcgttctagtaaggaaaacgccaagtaactttcccgaacccttctaacgaaagtagatacggtaaccttacaaaacgtaaccttacgtaaagtttggtaaactttccgtaggtaacccgggtaaaattaccgggtaaaaaccctttaaaacccggtaaacgggaaaaaaaaccccgggtcggggaaaacccggtaaaacccggggggaccttaaaacggtttcgggtttaaaatttttaaacggttttgggtttaacgggtttttacggtttttaaacgttttaatttaaacccgttaaggtaaaacgggggtaaaaccttttccggggttaaccccgtaacggggttcccggggggtaacccctttaaaacccgggggg

SEQ ID NO: 439164 - DNA, 667 bp, Homo sapiens
  misc_feature: GZ8MTXP02HUHTC.44.36.D03.1.454.CMB.2.raw
  modified_base (181)..(181): a, c, t, g, unknown or other
  modified_base (219)..(219): a, c, t, g, unknown or other
  modified_base (263)..(263): a, c, t, g, unknown or other
  modified_base (301)..(301): a, c, t, g, unknown or other
  modified_base (404)..(404): a, c, t, g, unknown or other
  modified_base (618)..(618): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtntccagagtgaagtgcaggttggtggaggtccggggganacttggccagccgtggaggtccctgagactctctgtgtcgcctntggatcacatcagtgaccatatatggactggggtcccnccgagggcctaccggaggggaacggggctaggggaggtcgggtcgttcgggaccgagtaaaacggtaaaaaacgaaaggttccggaccctagtaccttttaancaaccgtagacggttaccgccggacgttcgtagtacgaaaagcccaagtcttacccaccctactacaaagacagtacgtaccttacgaaaagtaacttctagtttagtactttcgaggacccgtaaagtacgtaaacctaaaccgtaaaggaaaacccgggagaaccgacggggactagttagttaatttagtggttacgttagtttacgttanagtaaccgtaggtaaccttcgccgtaacggccgggtacgtaacccgggg

SEQ ID NO: 439165 - DNA, 665 bp, Homo sapiens
  misc_feature: GZ8MTXP02H8LEF.44.36.D03.1.454.CMB.2.raw
  modified_base (314)..(314): a, c, t, g, unknown or other
  modified_base (395)..(395): a, c, t, g, unknown or other
  modified_base (434)..(434): a, c, t, g, unknown or other
  modified_base (504)..(504): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgttgggttttcctgtttgttattttacaaggtgtccagagtgaagtgcaggttggtggaggtccgggggagacgttgggtccaggccgtggggaggtccctgagctctcctgtgtccgctcgtggattcaccatcagtcgacctactatatggactgggtcccnccagggctccggaggggacggggctgggagtggggcttgggccgtacgaaaagtaaaaacgaggttccgaccagtctttanactacgaggtacgtaccgcgtacgttctaggtagaaacncccagtactccacccctctaacaagagtatcgtaacttacgaagtaactacgtatttcggtatttaccgngtacgaagtacgtaaccctaaaccgtaacgaaaccgggaacggaccgacggtaactagttagtttagttagtttaggttagtttacgtttagtttaacgtacgttaacgtaacggttaccgttacggtacccggtacgggtaccggggtacccggtacggg

SEQ ID NO: 439166 - DNA, 701 bp, Homo sapiens
  misc_feature: GZ8MTXP02J0M39.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttgggttttccttgttgctattttagaaggtgtccactgtgaggtgcggctgggtggagtcgtgggggaggcgttgggtacgagggccggggggggttccctggacgactctcctgtgcagcctctggattcatctcagtgactatcgccatgaacgtgggtccgccagggcctccggaggggaagggcgtagggtacggttggggttttccagtttagtgtttaaactagtttggcgtggaacgtactaaccctacctaacgtacgcagaccttcgtaggtggaaacggggtccgtaatttacccgaacctaacgttacccggaagggaactaaacgtcggaaaccctaaaaggaccttacaacgttcggttaaacttccgttaaagggaaaacttagggaaaacctacggtaccgtaaggaacggaaacggaaccggtacggggaacccgtacggggtacccgtttacgttacccgtttaacttttcgttaacggttaaccggacggtacgtaccggttacccggggtacctttacggtttcggg

SEQ ID NO: 439167 - DNA, 703 bp, Homo sapiens
  misc_feature: GZ8MTXP02JGU01.44.36.D03.1.454.CMB.2.raw
  modified_base (204)..(204): a, c, t, g, unknown or other
  modified_base (580)..(580): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgcttattttagaaggtgtccactgtgaggtgcggntggtgggagtcgtggggggaggcgtttgggtacgaggggccggggggggtccctggacgactctccgtgtgcagcctcgtggattcattccttcagtcgactatcgcctagtcgaacgtcgggtcccgccgaaggcctaccggagggggaacggggtcgtagggtaggtttcgggtttaccagttagttagtttaaatgtttgcgtagggacgtaactaacccgacccttactacgccaagtaccctcgtaggaggaaaccggggtctaacttaccaacccgtaagttaccccgaaggggacctaaacgtcgaaccccgaaaaggtaccttaccgaccgtttgtaaactaccggtaaggaaaacttcggaaaaccncggtaaccgtaggaacggaacggaaacgggaccgggtaaaccggtaccgtacgttcgtttaccgttccgtttcgtaacggtacgaaggtacggtaccggtccgggtaaccgtttacggttcgg

SEQ ID NO: 439168 - DNA, 810 bp, Homo sapiens
  misc_feature: GZ8MTXP02GST9Q.44.36.D03.1.454.CMB.2.raw
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtcagagtgaagtgcaggttggtggaggtccgggggatacgttgggtccaggccgtggacgggtccctgagactctcctgtgtcgcctntggattcacatcagtcgaccactatagtggacgtcgggtcccgcgtacggctccggaggggtaacggggcgtagggacggtgggtccgttcggggaccgaacgtaaaagtaaaaaacgtaaaggttcggaccctaggttactttacgtacaaacgtacgggtacgttacccggccggtcgttccgtaggtaacggaaaaccgtcccgtaaagtacctttaccccgaaccccttcgtaaccgaaaaggaggttaacttacgggtaaaccctttacgaaaacggttaaccttactaggtttaccgtaacgtttacccgtaaggtaacccggtaagtttaaccggaaaccccgttaaaaacccggttaaacgggaaaaaaacccccggtagggggaaacccgtaaacgggggtaccttaaaggtttaagtttaccgttttaaagggttttgggtttaccggttttaaggtttttaacggtttttaaaattacggaccggtttaaaaaggttaccggtttacccggtttaacccggg

SEQ ID NO: 439169 - DNA, 550 bp, Homo sapiens
  misc_feature: GZ8MTXP02G3369.44.36.D03.1.454.CMB.2.raw
  modified_base (230)..(230): a, c, t, g, unknown or other
  modified_base (394)..(394): a, c, t, g, unknown or other
  modified_base (408)..(408): a, c, t, g, unknown or other
  modified_base (460)..(460): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcaccatcctcctgcacgtggacnccaggcggtaatattcttagtcttaactttgtctcctggtactcaacatcattaccaaggtaaaccgcccccaaactcactacatctatgaggacctataagacgcctcgtaggggtttacaacgtcgcttcactcgcctacacgtccgacaacaccgcctccngacatctctcggcncgagctaggaggacgagctagtatttattacgttgttgctagatgtgttcgnactatctattgtacgtcgtacggaagtcggaaccgtagtaccaccgttacgtaacggtacacgaccctacggaccccaacccagttaccg

SEQ ID NO: 439170 - DNA, 775 bp, Homo sapiens
  misc_feature: GZ8MTXP02IJN6O.44.36.D03.1.454.CMB.2.raw
  modified_base (290)..(290): a, c, t, g, unknown or other
  modified_base (302)..(302): a, c, t, g, unknown or other
  modified_base (335)..(335): a, c, t, g, unknown or other
  modified_base (367)..(367): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcgtaggttgggtgggaggtccgggggagtaccgttggtccaggccgtgggacgggtccctggacgtactctccgtgtcgtcgccttntggacttcaccntcagtcgacctatatagtggacgtcgggtcccnccgaggctaccggaggggaacggggctagggnggtcggcgttcggaccgacaaaagtaaaaaccaagttcgacctagttctttagcaagacgtacgtacccgcgtacgtcgtagtacgaaaacgtccaagtaccttacccgacccttacaacgaaaggtacgaacttacggtaaacctttaaacgaaaataaccgttacgtaattttacggtaactttccgtagggttaaccgtaaaagtttaccggaaaaacctttaaaaccgggtaaaaccggaaaaaaccccggggtacgggaaaacccggaaacccggggttacttaaaacgggtttacggttttaacgttttaaaacggtttttggttaggtttttaacggtttagtttttaaacgtaaacgttaaaccggtacggggttaaaaccctttcgggtaaaccccggg

SEQ ID NO: 439171 - DNA, 576 bp, Homo sapiens
  misc_feature: GZ8MTXP02IDJ1Z.44.36.D03.1.454.CMB.2.raw
  modified_base (228)..(228): a, c, t, g, unknown or other
  modified_base (315)..(315): a, c, t, g, unknown or other
  modified_base (385)..(385): a, c, t, g, unknown or other
  modified_base (402)..(402): a, c, t, g, unknown or other
  modified_base (465)..(465): a, c, t, g, unknown or other
  modified_base (477)..(477): a, c, t, g, unknown or other
  modified_base (554)..(554): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggttgtaccaaagtgaagtgcaggttggtggaggtccggggganacgttggtccagcctgggaggtccctgagctctcctgtgtcgctctggattcaccatcagtgaccactatagtggactggggtcccncgaggctcgaggggagggctgggagtggcttggaccgagaacgtaaaaaacagttcgaccagtactttancacagacgtaccgccgngtctgtagaagcccaagtacttccaaccctctacaaaggactatacgacttacaaagtacctntattgatttccngacgtaatcgaaaccttacaagaaaaccacggtaacacggactattagttatttagttcgttgttgttaagtttaanatacgagtactgtaccctaggg

SEQ ID NO: 439172 - DNA, 772 bp, Homo sapiens
  misc_feature: GZ8MTXP02I5Z4Z.44.36.D03.1.454.CMB.2.raw
  modified_base (187)..(187): a, c, t, g, unknown or other
  modified_base (277)..(277): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtntccagagtgaagtgctaggttggtgggaggtccgggggagtacgttggtccagccgtgggacggtccctgagactctcctgtgtcgcctntggattcacatcagtcgacctactatagtcggacgtcgggtcccgccgaacggtcctaccgggaagggggaacggggtccgtaggggtacggtcggggtaccgttggggacccccgaaccgtaaaaacggttaaaaaaaaccgtaaacggtttcgaaccccgtaaggttaccctttttagacccaaaccggtaaggtaccgttacccggcccggtcggttaccgtaggtaacgaaaacgccctaaggtactttaccccaacccttcgaacaaaggacgtatacgtaaacctttacgaaaagtaacccttagtaatttacggtaacttccgtagtaaccgtaaagtaaccggtaaaccttaaaccgaaacgggaaaaaccccggaggtaacccgaacggggtactaaagtttacgtttaaagtttacgtttggtttacgtttgtttaagttttaaactagttaccggtaaagggttaccttacgggttaaccccgg

SEQ ID NO: 439173 - DNA, 891 bp, Homo sapiens
  misc_feature: GZ8MTXP02GHTH9.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagagactcaccatggagttcgggctgagcttgggttttccttgttgttatttacgaagtgtccagagtgaagtgcaggttggtggaggtccgggggagtacgttggtccagccgtgggacggtcctgagctctctgtcgtcgctctggactcaccatcagtcgaccatatagtcggacgtcgggtcccgaccgaggtccgtccggaagggggaacggggcgttggggacggttcggggccgtttcggggacccggtaacctaaaaacgggttaaaaaaaaccgtaaacgggtttccggaacccttaaacggttcctttttaacgccgtaaacggtaaacggtaacgggttaacccccggcccgggtacgtttaccgttacgggtaaacggtaaaacggcccctaaaggtaaccctttacccgtaaacccccccttacgttaaacccgaaaacgggtaagtaaaccgttacgttaaaacccgtttaacccgaaaaacggttaaaccctttaccggttaaaattttaccggtaaagtttaccccgttaggtaaaccccggtaaaagtttacggaaaaccccgtttaaaaccccggtaaaacgggaaaaaacccccgggttaaggtaaaccccggaaaccgggggtacccttaaaggtttaccggttttaaaagtttaccggtttttggtttaacggtttaagtttttaacgttttaaagttacgtaacccggtttaaaggggtaaacccttttcgggtaaaccccgg

SEQ ID NO: 439174 - DNA, 646 bp, Homo sapiens
  misc_feature: GZ8MTXP02GNFAY.44.36.D03.1.454.CMB.2.raw
  modified_base (218)..(218): a, c, t, g, unknown or other
  modified_base (385)..(385): a, c, t, g, unknown or other
  modified_base (388)..(388): a, c, t, g, unknown or other
  modified_base (433)..(433): a, c, t, g, unknown or other
  modified_base (441)..(441): a, c, t, g, unknown or other
  modified_base (452)..(452): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagccgtgggacgggtccctgagactctcctgtgtcgcctctggattcaccatcaagtgaccactatagtggactgggtcccgcagggcctccgaggggaacggggctgggagtgggcttgggaccgacaaaggtaaaaacaagtcgaccagtcttancanagagtacgcacgtctgtagaaagccaagtacttaccaccccttanagaaaganactagaactanaaacgtactactattgtactttcgagtaacgtaaataacgaaacctaaaccggtaaacggaaaaccgggtacggaaccgacggtaactaagtttagtttaaatttaggtttggttagttttagttaacgtttaataagtaacgtaaacggttacctacggtacccgacggggtacggggtaacccgtaacgggg

SEQ ID NO: 439175 - DNA, 716 bp, Homo sapiens
  misc_feature: GZ8MTXP02HGDNW.44.36.D03.1.454.CMB.2.raw
  modified_base (181)..(181): a, c, t, g, unknown or other
  modified_base (572)..(572): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtntccagagtgaagtgcagttggtggagtccgggggagacgttggtccagccgtgggacggtccctgagacctctcctgtcgtcgcctcgtggacttcaccatcagtcgacctatatagtcggtacctcggggtcccgaccgacgggtcctccgggaagggggaacggggtccgtaggggaggttcgggtacgtttcggggccccgtaaacgtaaaaacggtaaaaaaacgtaaggtttaccccgaacccgtaggttacctttttaacgacaaaccggaggtacggtaacccgtccggtccgttacgttagtaaggaaaccgcccgaagttacttacccaacccgtctacgaaagacgtagtacgtaaccttaacgaaatacttactatttanacgtttcacgtaaccgtaataccgtaacctaaaccgtaaacgaaaaccggacgaacgtacgggactaaggtagttattaagttgttagtttgttacgtttatatcgaagtaccgtcgtaccgacggttacggaccggtaaccgg

SEQ ID NO: 439176 - DNA, 559 bp, Homo sapiens
  misc_feature: GZ8MTXP02FO3KX.44.36.D03.1.454.CMB.2.raw
  modified_base (318)..(318): a, c, t, g, unknown or other
  modified_base (345)..(345): a, c, t, g, unknown or other
  modified_base (358)..(358): a, c, t, g, unknown or other
  modified_base (373)..(373): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgaacgaaaatcctacagtacatctctgaagagcagtttaaccatctccaagacacctacaaaggcaggtgtcttagtatgaccanatgacctgcgacaccagcacatatacngtgcgacggtaangacgggaaaagaaanagcttggtttctagtattataagttctacatctggacgtcgtagggacaaagggaccgacggtacaccgtctcccgtcacgtcctaccaccgaacgggccctaacgtccgggtcccttcccccgtcggcccgtcccctacgccctccggagaacgccaccgtcggcgggggaccacgacggcccgg

SEQ ID NO: 439177 - DNA, 556 bp, Homo sapiens
  misc_feature: GZ8MTXP02G4HKH.44.36.D03.1.454.CMB.2.raw
  modified_base (316)..(316): a, c, t, g, unknown or other
  modified_base (400)..(400): a, c, t, g, unknown or other
  modified_base (439)..(439): a, c, t, g, unknown or other
  modified_base (478)..(478): a, c, t, g, unknown or other
  modified_base (505)..(505): a, c, t, g, unknown or other
tcagacagtatatacacgaccggtgctcgatttagctgcgtcacgatctctcttgggagctctcagagaggtgccttagccctggattccaaggcatttccacttggtgatcagcaatgaacacagaggactcaccatggagttgggctgcgcttgggttttccttgttgcttattttagaagtgtccactgtgaggtgcggctgggtggagtcgtgggggaggcgttggtacgagggcgggggggtccctggagactcgtcctggtgcacgcctctggattcatcttcagtgactatgcctatgaacgtggtccncgaggctccgagggacgggtctggaggttggttccattagtgttaatagttgctggagtactacccactactacgcagtacctntgtagacgggctattcaaccctattcgaagggacaagtnaccaaagactacacgttagtaatcgtaagaaatgaaacngacctagaacggagaacggagtaccgnggacctgtaccttaacgttctggtcgagtacgacgtcgggacctagttcgg

SEQ ID NO: 439178 - DNA, 669 bp, Homo sapiens
  misc_feature: GZ8MTXP02H0J4T.44.36.D03.1.454.CMB.2.raw
  modified_base (282)..(282): a, c, t, g, unknown or other
  modified_base (293)..(293): a, c, t, g, unknown or other
  modified_base (412)..(412): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtgggaggtccgggggagtacgttgggtccaggcctgggacgggtccctgagtactctcctgtgtcgcctntggattcaccntcagtcgacctactatagtggacgtgggtcccgccgaggcctaccggagggggaacggggctaggggagtggtcgttggcccgataaacgtaaaaaacaggttacgcctagtactttancaacagagtaccgccgcgttcgtagtagaaacgcctaagtcttacccaccctactacgaaagacgtagtcgtaacttacgaaagtaacttactattagtaatttctacggacgtaaagtacgtaaacccgtaaaaccgtaaacggaaaaacccggtacgggaaaaccgaccggggacttaaagttacgtttaacgtttaagttggttacgtttaagttagtttaatacgtacgtaacggtacgtttacgtacccggg

SEQ ID NO: 439179 - DNA, 712 bp, Homo sapiens
  misc_feature: GZ8MTXP02HH9TP.44.36.D03.1.454.CMB.2.raw
  modified_base (327)..(327): a, c, t, g, unknown or other
  modified_base (365)..(365): a, c, t, g, unknown or other
tcagacagtatatacacgaccggtgctcgatttagctgcgtcacgatctctcttgggtcttgtcccaggtcaccttgaaggagtctggtcctgtgctggtgaaaccccacagagaccctcacgctgacctgcaccatctctgggttctctctcaacgatattagaatgggtgtgagctggatccgtcacgcccccgagggaacgccctggagtggcttgcacacatcttctacgaatgaacgaaaatcctacagtacatctctagagagctagttaaccatctacaagaccacctacaaagctaggtgtctttaagactacgacaanagtcgaccctggacgacaccgagccactatacttacgngtcgacgtaacgggtaatacgggaaacggggaaaagaaaccgtaggtaccgtttaggtttacttaagtttaatttaaagttaacgtttaccttacccgtaatttcggtacggtacggttaccggtagggggtaaaccgtaaacggggtacccgtaccggtaccgtacccgttccctacctaccgtaccgtacccgttacccgtaacccgaaccgggtaccccttaccgttccccggttacccccgtttcccccggtacggtccccgtaccccgttccgtcccggtacccgaaggtcccgtaccgtacccgttccggggacgggacccaccgggacccggtccccggg

SEQ ID NO: 439180 - DNA, 627 bp, Homo sapiens
  misc_feature: GZ8MTXP02GAZQ0.44.36.D03.1.454.CMB.2.raw
  modified_base (328)..(328): a, c, t, g, unknown or other
  modified_base (466)..(466): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggatacgttggtccaggccgtgggacgggttccctgacgtactctccgtgtcgtcgcctcgtggacttcaccatcagtcgaccactatgtggacgtcgggtccnccgaggctccgaggggaaggggctgggagtcggtgtcggccgtacgaaagtaaaaacaaggttcgaccagtctttagtcaacagtagtaccgcgtcgtctggtagaaacgccaagtacttcccgaccctctacaaagngatcgtaacttacaaagtacttacagttagtattacgagacgtaactacgtaaccctaaaaccgtacggaaaacccgtacggaaaccgagggacctagttaacgttacttagtttgttagtttgttagtttaacgtattacggtagtaacttacggtaccg

SEQ ID NO: 439181 - DNA, 797 bp, Homo sapiens
  misc_feature: GZ8MTXP02FGMCI.44.36.D03.1.454.CMB.2.raw
  modified_base (440)..(440): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttggtgggaggtccgggggagaccgttgggtccaggcccgtgggacgggtcccctgacgactctccttgtcgtcgcctctggatcaccatcagtcgaccactatagtcggacgtcggggtacccgccgaggcctaccggaagggggaaacggggctaggggagtgggcgttcggggaccgacccgaaaaggtaaaaaaccgaaaggtttcgacccgtaaggttcctttttacnccgaaacctaagggaacgtaacccgcccggtcgttacgttacgtaagaaaacgcccgaaagtacctttacccacccccttcgaacaaaaggtagtaacttacggtaaacctttaacgaaaaccggttaacctacctaagtttttcggaaacttttccgacggtaaccggtaaaattcggaaaacccctttaaaccgtaaacgggaaaaaaaacccggacgggggtaaacccaaaccgggggtacctaaaggtttaccggttaaacttttaacgtttcgggtttaaggttttggggtttaattttttaaaccgaagtttaccgtaaaacggggttaaaccttcggttaaacccccggg

SEQ ID NO: 439182 - DNA, 665 bp, Homo sapiens
  misc_feature: GZ8MTXP02FM4ZA.44.36.D03.1.454.CMB.2.raw
  modified_base (416)..(416): a, c, t, g, unknown or other
  modified_base (421)..(421): a, c, t, g, unknown or other
tcagacagtatatacacgaccggtgctcgatttagctgcgtcacgatctctcttgggggagctctgagagcggagccccagccccagaattcccaggtgttttcatttggtgatcagcactgaacacagaggactcaccatggagttcgggctgagcttgggttttccttgtttgttattttacaaggtgtccagagtgaagtgcagttggtggaggtccgggggagacgttggtccagccgtgggacgggtccctgagactctcctgtgtcgctgtgatcacatcagtcaccactatagtggacgtcgggtcccgccgaggcctaccggaagggggaacggggcgtaggggaggtcgggcgttcggggaccgaccgaaaaggtaaaaaaccaaggtttcgaccctagttctttanccaanaggacgtaccgccgcttcgtagagaaacgcaagtacttcccaccctctaacgaagagtatcgtaaccttacaaaagtacctcgtaattgtacttcgtagacgtaacgttacgaaacccttaaaccgtaacggaaaaacccggtacggaaccggacgggtactaagtttacgttaacttttaggtttaggtttagtttaagtttagtttaactacgtacggtaacggtaaccttcggtaacccgg

SEQ ID NO: 439183 - DNA, 582 bp, Homo sapiens
  misc_feature: GZ8MTXP02FJ3DI.44.36.D03.1.454.CMB.2.raw
  modified_base (371)..(371): a, c, t, g, unknown or other
  modified_base (396)..(396): a, c, t, g, unknown or other
  modified_base (429)..(429): a, c, t, g, unknown or other
tcagacagtatatacacgaccggtgctcgatttagctgcgtcacgatctctcttgggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagcctggaggtccctgagactctcctgtgtcgctctggattcacatcagtgaccatatatggactgggtccgcaggctccgaaggggagggctgggagtggcgttggccgacaagtaaaaacaagttcgcagtctttancaacaggacgtacgcgcgtctgtanaaaggcccaagacttccaacccctctacaaagngaatggaaccttcaaagtactcaatttagattacctagacgaaacttcggaaacctaaaccgtaggaaaaacccggaggaaccgacgggactagttacgttatttaacgtggtttagttgtttagtttatacgtacgaaggactggtaacccg

SEQ ID NO: 439184 - DNA, 708 bp, Homo sapiens
  misc_feature: GZ8MTXP02GL9L5.44.36.D03.1.454.CMB.2.raw
  modified_base (217)..(217): a, c, t, g, unknown or other
  modified_base (273)..(273): a, c, t, g, unknown or other
  modified_base (278)..(278): a, c, t, g, unknown or other
  modified_base (300)..(300): a, c, t, g, unknown or other
  modified_base (403)..(403): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctgggaggtccctgagactctcctgtgtcgctctgattcaccancagtnaccatatagtggactgggtccnccgaggtcctaccgaggggaacggggtctgggagtgggcttgggacccgagtaaagtaaaaaactaaggttccgaccagtactttagacactaaggacgtacnccggtagtcgtgtagaaacgtcccaagtacttcccgacccttctacaaaaggctatagtacctttagaaaacgtaaacttcgtaatttcggtaactttacccgtagaacggtaaaactccgaaaacccgtttaaacccaaagggaaaaaaccccgggacggaacccgtaaacgggtacttaacgttaacggtttaaattttacggtttagtttaaggttttacgttaacgtttaaactagtaaaccggttaacggtaacgttacggttacccgtaacggggtaaccggggtaacccgtaaccggg

SEQ ID NO: 439185 - DNA, 630 bp, Homo sapiens
  misc_feature: GZ8MTXP02G028J.44.36.D03.1.454.CMB.2.raw
  modified_base (390)..(390): a, c, t, g, unknown or other
  modified_base (452)..(452): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagtacgttggtccaggcctgggacgggtccctgacgactctccgtgtcgtcgcctctggattcaccatcagtcgaccactatagtggactcgggtcccgccaggctcgaggggagggctgggagtggctggcgaccgaagtaaaaactaagtcactagtactttancacgagacgtacgccgtcgtcgtgtagaaacgccgaagtacttcccgaccctctacgaaganatcgaacgttacaaagacttatattgtacttacgagacgaatacgaacttaaacccgaagaaaacccggaacggacgaacggggtctaaagttacggttaatttacgttgtttaggtttaagttttacggtttaaaattacgtaacggtaaacggttaaccgtacggttaacccccgg

SEQ ID NO: 439186 - DNA, 842 bp, Homo sapiens
  misc_feature: GZ8MTXP02FNLVE.44.36.D03.1.454.CMB.2.raw
  modified_base (226)..(226): a, c, t, g, unknown or other
  modified_base (253)..(253): a, c, t, g, unknown or other
  modified_base (287)..(287): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctagttggtggaggtccggggganacgttggtccagccgtggagggtcccngagactctcctgtcgtcgctctggattcacctancagtcaccactaatagtggacgtcgggtcccgcgacggccgtacccggaggggaaacgggggtcctaggggtaacggtcgggtccgtttacggggaccccgaaccgtaaaaaggttaaaaaaaaaccccttaaaagggtttcggaacccccgtaaaggtttaccctttttaagtcccaaaacgtaaaacgggtacgggtttaccccggaaccccggtcggttacccgttaaagggttaaccggaaaaaccggcccgtaaacggtaaaccctttttaaccccgaaccccccttacttaaacccgaaaagggtacgtaaacttacggtaaaacctttaaccgaaaacggttaaccctacttaagtttagtaaccttccgttaggaaacgtaaacgttacggtaaaccttaaacccggtaaaggaaaaaacccgggaacggacccggtaaacgggggaacctaaggttaacgtttaactttaacggtttggtttagtttaagggtttagttttaaacttacgaccgttaaaggggtaaccttcggtttaaaccccggg

SEQ ID NO: 439187 - DNA, 562 bp, Homo sapiens
  misc_feature: GZ8MTXP02HVKQR.44.36.D03.1.454.CMB.2.raw
  modified_base (370)..(370): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaatcctacagtacatctctgaagagcagtttaaccatctccaaggcactaccaaaaggcaggtggtctttagtatgacaacatgacctgcgacacagcacatattactgtgacgacggtatgacgggaaanaaacagcttggttctgttattataagttcttaacatctggtacgtcgtgggacaaagggacgacggtccaccgtcctccgtcacggccttaccgaacccgaacgggccccaagtcccgggttcctttcccccgtggcccgcccgtcgcccgtccgacggaacgcacccgtcgtcgggggccacgacgcccgg

SEQ ID NO: 439188 - DNA, 538 bp, Homo sapiens
  misc_feature: GZ8MTXP02J04EY.44.36.D03.1.454.CMB.2.raw
  modified_base (348)..(348): a, c, t, g, unknown or other
  modified_base (430)..(430): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgctgggttttccttgttgctattttagaaggtgtccactgtgaggtgcggctggtggagtcgtgggggagcttgggtacagggcgggggggtccctggagactctcctgtgcagcctctggattcattctcagtgactatgccatgaactggtccgcaggctcgagggagggctggagtggttccatatgttaatntgctggagactaccactactacgcagactcgtgagacggccattcgactaattccgagggacaatcgaccaaagactcactntactctaggaaatcgaaactcgaccgtagaacgacggaacggacggaccgacgggtctcgtaccgttactttcgcgttcgagacgtacgtccgggaccttaggttcgg

SEQ ID NO: 439189 - DNA, 628 bp, Homo sapiens
  misc_feature: GZ8MTXP02HUWYZ.44.36.D03.1.454.CMB.2.raw
  modified_base (313)..(313): a, c, t, g, unknown or other
  modified_base (319)..(319): a, c, t, g, unknown or other
  modified_base (321)..(321): a, c, t, g, unknown or other
tcagacagtatatacacgaccggtgctcgatttagctgcgtcacgagtctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccgagggaacggccctggagtggcttgcacacatcttctcgaatgaacgaaaatcctacagtacatctcagagagcagttaaccatctacaagacacctacaaagcaggtgtacttagtangaccanancgacctgcgacacagcacatatactgtcgacgaacggtaagtacggaacgggaaaagaaacgtagtcgttaggtttactaggttaattaagtaacgtttacgttacctattaccgtagggtacgtacggttagggaccgaaaagggcccgtagggtacctaccggtacctccgtacgacggtaccttaccggaaccgaacggggtaccccagtttacccggtcccgttacccccgtcggccccgtcccgtcgacccgtacccgaggaaccgccgtaccgttcgggcgggaccaacgtccggacccgg

SEQ ID NO: 439190 - DNA, 665 bp, Homo sapiens
  misc_feature: GZ8MTXP02G71YD.44.36.D03.1.454.CMB.2.raw
  modified_base (196)..(196): a, c, t, g, unknown or other
  modified_base (265)..(265): a, c, t, g, unknown or other
  modified_base (356)..(356): a, c, t, g, unknown or other
  modified_base (393)..(393): a, c, t, g, unknown or other
  modified_base (546)..(546): a, c, t, g, unknown or other
  modified_base (555)..(555): a, c, t, g, unknown or other
  modified_base (594)..(594): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgnagttggtggaggtccgggggagacttggtccagcctgggagggtccctgagactctcctgtgtcgcctntggattcaccatcagtgaccactatatggactgggtccgccaggccgtaccgaaggggaaggggcctgggacggtgggcgttcgggccganaaaggtaaaaaacgaaagttcgaccctaagcttttancgaacagacgtaccgcgcggtactgtagaaacgccctaagactttacccgaccctctacaaagacgtatacgaaaccttacgaaaacgtaactactaattaggtactttcgtagacgtaaatcggtaaaacttaacccgaaggaaaaccccgngggaaaccncggggactaagttgttaaatttacgttggttagggtttnttacggtttaataccgttaacgaaggttaaactcggttaacccgacggtacgggggacccgtaaccggggg

SEQ ID NO: 439191 - DNA, 747 bp, Homo sapiens
  misc_feature: GZ8MTXP02GS53Z.44.36.D03.1.454.CMB.2.raw
  modified_base (350)..(350): a, c, t, g, unknown or other
  modified_base (376)..(376): a, c, t, g, unknown or other
  modified_base (379)..(379): a, c, t, g, unknown or other
  modified_base (382)..(382): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccgtgggaggtccctgagactctcctgtgtcgcctctggattcaccatcagtcgaccctactatagtggactgggtcccgccaggcctccgaggggaagggctgggagtgggcttggccganaagtaaaaacagtcaccagtctttancanagngtaccgcgacgtctagacgaaagcccaagtacttacccacccctactacgaaaggacgacttacggtaaaccttacgaaaacgtaaccttacgtaatttagtaactttccgtaggttaacccgtaaaagtaaccgtaaaacccgttaaaaccccgttaaacggggaaaaaaaacccccggaacggggaaaccccgaaaaccgggggtaccttaaacgtttaaagggttttaaactttttaacggttttagggtttaaacggttttttcgtttaacgggtttttaacttaaagtaaccggtaaaagggttaaaccttcgggttaaaccccgtacgggtttccgggggaaccccgtaaacccggggg

SEQ ID NO: 439192 - DNA, 705 bp, Homo sapiens
  misc_feature: GZ8MTXP02H7AK7.44.36.D03.1.454.CMB.2.raw
  modified_base (334)..(334): a, c, t, g, unknown or other
tcagacagtatatacacgaccggtgctcgatttagctgcgtcacgatctctcttggggagctctgagagcggagcccagccccagaattcccaggtgttttcatttggtgatcagcactgaacacagaggactcaccatggagttcgggctgagcttgggttttccttgtttgttattttacaaggtgtccagagtgaagtgctaggtttggtgggaggtcgggggagtacgttggtccaggccgtgggacgggtccctggacgtacttctcctggtcgtcgtccctgtggacttcaccatcagtcgacctatatagtcggtacgtcgggtccnccgaggcctaccggaggggaggggcgtgggaggtcggtcgttcggaccgtacgaaagttaaaaaccgaagttcacgtaagtctttatcgaacgacgtacgtaccgcccgtacgttctagtacgaacgacccaggtactccctaacccttcaaccgaaagacgtactacgaaccttaacgaaacgtaaccttgtattagtacgtttacgacggtaacgtaaacgtaacgttaaacctaaaccgtaaaacgggaaaacccgaacgggaaaccgtacggggtaactaaagttcggtttaatttaacggtttggtttagtttaaggttttaagtttaagttacttacggtaaacggttaacttacggtaacccgg

SEQ ID NO: 439193 - DNA, 749 bp, Homo sapiens
  misc_feature: GZ8MTXP02IR1RA.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatcccgtcacgccccccgagggaacggcccgtggagtggcttgcacacattcttctcgaatgaacgaaaatcctacagtacatctctagaagagctaacgtttaaccattacctaccgaaacggacccaaccctaacccgaaaaagggtcctaggggttcggtttaccttttaagtaacgttacggaaacccctaaacgtacgttccgggacccctaggacccggacaaccccgacggaccaactaagttaacttacgtgtcgaccggtaaccgggttaaagtacggaacgggggaaaaagaacgtaggtccgtttaggtttacgtagttaagttattaaagttaccttacctagttcgttacgggtacgtcgtagggggaaccgtaaaacggggaccctaccgggttaccctaccgtcccgtaccctcgtaaccgtccttaacccgaccgaaccgggtccctaccgttcccgggttcccgttcccccgtcgggtccctccccgttcgcccgttaccgacggaacgtcccgtaaccgttcgggaccggggacctaccggccggtcccggg

SEQ ID NO: 439194 - DNA, 570 bp, Homo sapiens
  misc_feature: GZ8MTXP02I7NQ0.44.36.D03.1.454.CMB.2.raw
  modified_base (181)..(181): a, c, t, g, unknown or other
  modified_base (218)..(218): a, c, t, g, unknown or other
  modified_base (285)..(285): a, c, t, g, unknown or other
  modified_base (307)..(307): a, c, t, g, unknown or other
  modified_base (343)..(343): a, c, t, g, unknown or other
  modified_base (370)..(370): a, c, t, g, unknown or other
  modified_base (373)..(373): a, c, t, g, unknown or other
  modified_base (376)..(376): a, c, t, g, unknown or other
  modified_base (385)..(385): a, c, t, g, unknown or other
  modified_base (396)..(396): a, c, t, g, unknown or other
  modified_base (411)..(411): a, c, t, g, unknown or other
  modified_base (417)..(417): a, c, t, g, unknown or other
  modified_base (419)..(419): a, c, t, g, unknown or other
  modified_base (436)..(436): a, c, t, g, unknown or other
  modified_base (445)..(445): a, c, t, g, unknown or other
  modified_base (473)..(473): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtntccagagtgaagtgcaggttggtggagtccggggganacgttggtccagccgtgggagggtccctgagactctcctgtgtcgcctctggattcaccatcaagtnacccatatagtggactgggccncaggctcgaggggaggctggagtggcttggcccganaaagtaaaacaagttcaccagtcttancanagngtacgccgntctgagaaacnccaagcttccacctnacaagnanagtactacaaagtactnattgattcngagaaatgaactaacgagaaaaccgggngacgacggatagttagttaattagttgttagtttagttacgtttaagtacgtaacgaacggtacgttacgtaccgtacggtcggggaaccgtaacgg

SEQ ID NO: 439195 - DNA, 748 bp, Homo sapiens
  misc_feature: GZ8MTXP02G7IMW.44.36.D03.1.454.CMB.2.raw
  modified_base (276)..(276): a, c, t, g, unknown or other
  modified_base (316)..(316): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccgggggagacgttgggtccagccgtgggacgggtccctgacgactctcctgtgtcgctnggatcaccatcagtcgaccactatagtggacgtggtcccncgaggcctcgaggggacgggctggagtggcttgggacgaccctaaagtaaaacaaggttcgaccctagtctttagtccaacgagtagtacccgccggtcgtcctagggtacaaaacgtcccgaagtacctttacccgaacccccttgtaaccgaaaagggtataacgttcggtaaaccctttaccgaaaaggttaaccctttcctaaaagtttttcgaaagtttttaccccgaaggtaccgttaaaagttaccgggtaaaacccctttaaacccggtaaaagggaaaaaaacccccgggtggggaaaccccgttaaacgggggtcctaaagttaaccggggttttaactttaacgtttggggtttaatttcggtaagtttttaaaacgacgttacggtaaaccggttaaacccggttgtttaacccccgggg

SEQ ID NO: 439196 - DNA, 711 bp, Homo sapiens
  misc_feature: GZ8MTXP02GX57E.44.36.D03.1.454.CMB.2.raw
  modified_base (310)..(310): a, c, t, g, unknown or other
  modified_base (333)..(333): a, c, t, g, unknown or other
  modified_base (339)..(339): a, c, t, g, unknown or other
  modified_base (395)..(395): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagcgtggtttctgttagttatttacaaggtgtcagagtgaagtgcagttggtggaggtccgggggagacgttggtccaggccgtgggacgggtccctgacgtactctcctggtcgtcgcctcgtggtattccaccatcagtgaccatatatggactgggtccncgaggcgtccgaggggacggggngtaggngtcggtcgtacggaccgtaagaaaacgtaaaactagtacccgacgtagttacttanacgaacgagtacgtaccgcggtacgtacgtagtaacgaaacgtaccgaagtacctacccacctacgacgaagacgtacgtacgtaactaacgaaacgtaactactagttactacgttacgtacgtacgtaaacgtaaccgtaaacccgtaaacggtaaacggaaaaccggtacggtaaaccgggaacggtaacttaaaggtttacgtttaagtttaggttaggtttacggtttacgtttaacgttaacgtacgtaacggtaaacggttaaccgttaccggtaccggtaaccggggtaccggggaaccgtaaccggg

SEQ ID NO: 439197 - DNA, 643 bp, Homo sapiens
  misc_feature: GZ8MTXP02GTE8P.44.36.D03.1.454.CMB.2.raw
  modified_base (202)..(202): a, c, t, g, unknown or other
  modified_base (278)..(278): a, c, t, g, unknown or other
  modified_base (287)..(287): a, c, t, g, unknown or other
  modified_base (302)..(302): a, c, t, g, unknown or other
  modified_base (314)..(314): a, c, t, g, unknown or other
  modified_base (404)..(404): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttatttacaaggtgtcagagtgaagtgntaggttggtgggaggtccgggggagtacgttggtaccgagccgtgggacgggtccctgacgctctctgtgtcgctnggatcaccntcagtgaccactatnggactgggtccncgaggccgtacgaggggaagggtcgtagggagtggtctcggggaccgtaccgaaaagtaaaaaacgaagttcgaccgtagttactttacnccgaacgagaccgtccgccggtcgttcgtagtacgaaacgcagtacctaccctacctacgtaacgaaagtacgtactacgtaaccttaacgaaacgtacttagtacgttagtacgttacgtacgaagtaataaccgaacctaaacggaaaccgaaaaccggacggaaccggacggtactagttagttactttagttgtttagttgttaatttacgtacgtacgacgtacgttcgtacgg

SEQ ID NO: 439198 - DNA, 604 bp, Homo sapiens
  misc_feature: GZ8MTXP02H2UAZ.44.36.D03.1.454.CMB.2.raw
  modified_base (186)..(186): a, c, t, g, unknown or other
  modified_base (304)..(304): a, c, t, g, unknown or other
  modified_base (321)..(321): a, c, t, g, unknown or other
  modified_base (397)..(397): a, c, t, g, unknown or other
  modified_base (416)..(416): a, c, t, g, unknown or other
  modified_base (547)..(547): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtctgggtttccttgttgttattttacaggtntccagagtgaagtgctaggttggtggaggtccgggggatacgttggccaggccgtgggacgggtccctggacgtactctctgtgtccgctctggacttcaccatcagtcgacctatanagtcggactcgggtccnccaggctccggaggggagggctagggagtggcttggccactaaagtaaaaaaccaggttcgacctagttactttancaagagtacgtaccgccgnttcgtagtagaaacgcctaagtacttcccaacccttgactaaaggatatcgaacttacgaaacttaacttcaatttcggatttacgagacgtaatcgaaaccttaacgagaaaaccggtggaaacgacggntaagttacgttacttagttgtgtttaagttagttatcgtagaacggttctacgtccg

SEQ ID NO: 439199 - DNA, 555 bp, Homo sapiens
  misc_feature: GZ8MTXP02FFMOU.44.36.D03.1.454.CMB.2.raw
  modified_base (261)..(261): a, c, t, g, unknown or other
  modified_base (307)..(307): a, c, t, g, unknown or other
  modified_base (379)..(379): a, c, t, g, unknown or other
  modified_base (424)..(424): a, c, t, g, unknown or other
  modified_base (432)..(432): a, c, t, g, unknown or other
  modified_base (539)..(539): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccgggggagacttggtccagccgtggagggtccctgagactctcctgngtcgctctggattcaccatcagtgaccactatatggactgggtccnccgaggctcccgaggggaaggggctggggagtggcttcggccgcgaagtaaaaaacaagttgccagctttancacagagtacgcgcgtctgtagaaagcccaagacttcaacccctntacaaagngactgaccttacaaagactcaatttgattccgtagaccgtaatcgaactaaccgtagaaaacccgaggacacgggcaagtcgtacttagtgttagtaagttgtttanatcaggaactgtaccg

SEQ ID NO: 439200 - DNA, 663 bp, Homo sapiens
  misc_feature: GZ8MTXP02GKPYU.44.36.D03.1.454.CMB.2.raw
  modified_base (320)..(320): a, c, t, g, unknown or other
  modified_base (478)..(478): a, c, t, g, unknown or other
  modified_base (542)..(542): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcaggttggtgggagtccgggggagacttgggtccaggccgtgggacgggttccctgagactctccgtgtgtcgccctgtggacttcaccatcagtcgaccactatagtggactgggtccnccgaggcctccggaaggggaacggggtctggggtacgtgggtccgttggggaccgaccaaaaggtaaaaaacctaagttcgaccctaagtcttttagcaacgaaggagtaaccgcggacgttacgtagtaaaagcccaaagtacttacccacccttanacctaagaagtactagtaacccttagaaacgaaacttcctatactagtttacacgataaacgtntaaacctaaaccgtacggaaaaaccggacggaacggaacccggtataacgttaggttaattttaacgttggtttacgtttagtttgtttaacttatcgaaggtaaccttgtacccgtacgg

SEQ ID NO: 439201 - DNA, 599 bp, Homo sapiens
  misc_feature: GZ8MTXP02IUW9Z.44.36.D03.1.454.CMB.2.raw
  modified_base (352)..(352): a, c, t, g, unknown or other
  modified_base (429)..(429): a, c, t, g, unknown or other
  modified_base (453)..(453): a, c, t, g, unknown or other
  modified_base (503)..(503): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttcctgttgttattttacaaggtgtccagagtgaagtgcgaggttggtgggaggtccgggggagacgttggtccagccgtgggacgggtcctgagactctcctgtgtcgcctctggattcaccatcagtcgaccactatagtggacgtcgggtccgccaggcctcgaggggagggctggagtggcgttggccgtanaagtaaaaactaaggttcgccagtcttatcacagcgtccgcgcgtctgagaaacgcagtctccacctctacaaaganacgtgtaccttaagaaacgtactntaaattgaatttctagacgtaatcgaaccttaaacgtagaaaaacccggnggaccgacgggactaagtcgttaatttactttggtgtttgttactttatagtaacgtaaggtaactcgtacccgacggtcggggacccgtaacggg

SEQ ID NO: 439202 - DNA, 630 bp, Homo sapiens
  misc_feature: GZ8MTXP02JUSLZ.44.36.D03.1.454.CMB.2.raw
  modified_base (315)..(315): a, c, t, g, unknown or other
  modified_base (389)..(389): a, c, t, g, unknown or other
  modified_base (419)..(419): a, c, t, g, unknown or other
  modified_base (448)..(448): a, c, t, g, unknown or other
  modified_base (473)..(473): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggagacgttggtccagcctggagggtccctgagactctcctgtgtcgcctctggattcaccatcagtcgaccactatagtggactcgggtccncgaggctccgaggggagggctagggagtggcttggaccgacgtaaagtaaaaacgaagttcgacctagtctttnacacagacgtccgcgcgtctgtagaaaacncaagacttcccgaccctctaacaaggtanattcgaacttacgaaaacgtacctntatttgaacttcgagtaccgaaattcaaaccgttaaaccagggtaaaaacccgacgggaaaccggacggacctagtttaggttaacttacgttttggttaaggtttgtttaacgtttttaagacgttacgaacgggttaaacttcgtaacccccggg

SEQ ID NO: 439203 - DNA, 546 bp, Homo sapiens
  misc_feature: GZ8MTXP02I5YMV.44.36.D03.1.454.CMB.2.raw
  modified_base (371)..(371): a, c, t, g, unknown or other
  modified_base (381)..(381): a, c, t, g, unknown or other
  modified_base (395)..(395): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgtcttggtttttccttgttgcttattttagaaggtgtccactgtgaggtgcggctgggtggagtcgtgggggaggtcttgggtacgagggccggggggggtccctggagactcgtccctggtgcagcctctggattcattcttcagtgactatcgccatgaacgtcggtccgcgaggcctcgaggggagggcgtggaggttggttcagttatgttaatnttgctggganataccactacacgnagactctgagaggcccataccactatccgaggaacagtcgaccaaagtactcacgtgtatcgtaaggaaatcgaacagccgtagaagacgacggaggacaccggtcttcgtacttctcgtgtacgagtacgtacgtccggtactacggtcg

SEQ ID NO: 439204 - DNA, 788 bp, Homo sapiens
  misc_feature: GZ8MTXP02G4W78.44.36.D03.1.454.CMB.2.raw
  modified_base (276)..(276): a, c, t, g, unknown or other
  modified_base (284)..(284): a, c, t, g, unknown or other
  modified_base (486)..(486): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgttattttacaaggtgtccagagtgaagtgcaggttggtggaggtccgggggatacgttggtccagccgtgggacggtccctgagactctcctgtgtcgcctntgatcacntcagtcgaccatatagtcggacgttcgggcccgccgaggtcctaccgggaaggggaacggggtcgtagggtacgggtcgggtccgttcggggaccgtaaccgtaaaacggtaaaaaacgtaacggttcgaccgtaaggttacttttacgcctaaacgtacggaacgttcccggccgtcgttaccgtaggtaaacggaaaccncccgtaaggtacctttacccccaacccctttgaacggaaaaggtacgtactacgtaaacccttaacgaaaaacgtccctttacgtaagtttacggtaacttccgtaggggtaaaccctaaaagttaccgggtaaaaacccttaaaacccgggtaaacgggaaaaaacccccgggtaggaaacccccggggtaacgggtacttaaaggtttaacggtttaaacttttaaggtttggtttaccggtttaagtttagtttaaacccgtgtaaccgtaaacgggttaccgtttacgtaccccgggg

SEQ ID NO: 439205 - DNA, 722 bp, Homo sapiens
  misc_feature: GZ8MTXP02GHCR7.44.36.D03.1.454.CMB.2.raw
  modified_base (285)..(285): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgtttgttattttacaaggtgtccagagtgaagtgcaggttgggtgggacggtccgggggagtacgttggtccagtccgtgggacgggtccctggacgactcctctgtgtccgctntgtacttcacatcagtcgaacctatatagtggacgtcgggtaccgcgacggccgtaccggaaggggaggggcgtgggtacggtcggtcgttcggaccgacgtaaaacgtaaaactaacggttcgaccgtaagttctttataccgaacgtaggaacgtaccgacccgcgttcctaggtaacgaaacgtacccaaggttaccttaccacccccgtataacgaagtacgtagtactaacgttaacgaaagtaaccttataagtttacggtactttcgacggtaacgaaacgttaccgtaaaacccgttaaaaccgtaaaacggggaaaacccgtaaacgggaaaccggacgggtaacttaaaggttacgtttatttaacggttgtttaggtttaagtttacgtttaataggttacaacggtacgtttaccggtaaccggg

SEQ ID NO: 439206 - DNA, 586 bp, Homo sapiens
  misc_feature: GZ8MTXP02IEC4S.44.36.D03.1.454.CMB.2.raw
  modified_base (224)..(224): a, c, t, g, unknown or other
  modified_base (277)..(277): a, c, t, g, unknown or other
  modified_base (359)..(359): a, c, t, g, unknown or other
  modified_base (454)..(454): a, c, t, g, unknown or other
  modified_base (465)..(465): a, c, t, g, unknown or other
  modified_base (532)..(532): a, c, t, g, unknown or other
  modified_base (565)..(565): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagcctgggagggtccctgagactctcctgtgtcgcctctaggnttccaccatcagtcgaccactatagtggacgtcgggtccgccaggcctccggaggggacgggctggagtggcgttggccganaaagtaaaaacagttcgaccagtacctttagccacgaagtacgtaccgcgcgttctagtgaaacgccaaagtcttcccgaccctctacgaagtanatgaaccttanaaagtactctatttggaatttcgagcgtaaatcgaacttaaacaggaaaacccgaggtacgacgggntaaagtcgttattagttgttgttgtagttttanactacgaacgtactcgtaccg

SEQ ID NO: 439207 - DNA, 699 bp, Homo sapiens
  misc_feature: GZ8MTXP02GT3AK.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggtttttccttgtttgtttattttacaaggtgtccagagtgaagtgctaggttggtggaggtccgggggagtaccgttgggtccaggccgtgggacggtccctgagactctccgtgtcgtcgcctctggatcaccatcagtcgacctactatagtcggacgtgggtcccgccgaggcctaccggaggggaggggcgtgggagtcggcgttcggaccgacgtaaacgtaaaaacgtaaggttcgacctagtctttacgcaacgtagtacgtaccgccgtacgtctagtagaaacgccgaagtacttcccgaccctctacgaaagtagtactacgtaaccttacgaaacgtactacctagtttcgtaacttcgtagtaaccgtaatacggaaaccttaaaacccgtaacggaaaaacccggtacgggaaacccgacgggtacctaaagtttagttaaacgtttttaagttggttttagttaaggttttagttttaaacgttacgttacggtaaacggttaaaccgtcggttaaacccccgg

SEQ ID NO: 439208 - DNA, 671 bp, Homo sapiens
  misc_feature: GZ8MTXP02IR2Q4.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggcctggagtggcttgcacacatcttctacgaatagaacgaaaactcctaacagtacactctctagaagagtcaagtttaaccatacctaccgaacggaccaccgtaaccgaaaggctagggtgttacgtttagtatacgaaacccaacgacgttccggacctggaccggtacacgacggacactaatattactgtgacgtaagggtaatggaacggaaaagacgagtcgttagtttactagtaattaacgtactcgtaactgtacggtacgtacgttacggacgggtaaaccgtaaacgggtaccgttcggtaaccctccggtaccttccaaccgttcgtacccttaccgaacggttacccggtacctccggttcccgttccccgttcccggccggcccgtaaccgtccgaccgtaccgagaacccgtaccgttccggacggggacgacccgacgtccgggtccccgg

SEQ ID NO: 439209 - DNA, 858 bp, Homo sapiens
  misc_feature: GZ8MTXP02IY9KL.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaagtgggtgtgagctggatccgtcacgccccgagggacgccgtggagtggcttgcacactattcttctacgaatacgaaacgtaaaactcctaacacgtaactactcctacgtagaaagacgtactaaacgtttaaaccactacctaaccgaaacggaaccctaaccgtaaccgaaaagggtaccgtaaggggttacggttaccgtttaaggtaacgtacgaaacccgtaaacgtacgtaccggacccgtacggaccggaacaaccgacgacctaactaactttaacgttaacgtggtacggtaacggtaaacgggttaacgtacggggaaacggggtaaaaacgaaacgtagttaccgtttaggtttacttaaaggttaaatttaaacgttaaacgttaccttaaccaagtttaccggtacgggtacggtcggttaaagggggaaacccgtaaaacggggtacccgttaccggtacccgttaacccggttcccttaaccgtaccggaaccgtttacccgttaaccccgtaaacccgggaacccggtacccccgttaacggtttccccggttaccccccgtttcccccggtcgggaacccccggttccccgttacgccccgttaaccggaacgggtaaccctacccgtacccgggttcggggaccggggacccaaccggggccgtcccccggggg

SEQ ID NO: 439210 - DNA, 819 bp, Homo sapiens
  misc_feature: GZ8MTXP02HGUUI.44.36.D03.1.454.CMB.2.raw
  modified_base (220)..(220): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatgggagttcgggctgagctgggttttccttgttgttattttacaaggtgtccagagtgaagtgcagttgggtggaggtccggggganacgttggtccaggcctgggacgggtcctgagtactctccgtgtcgtcgccttacgtggtacttcacccatccagtacgacctactatagtcggacgtcggggtacccgccgagggcctaccggaggggaaggggctaggggaggtcgggtcgttcgggcccgagtaaacgtaaaaaactaagttccgacctagtactttacgacaaccgtaaggtacgttaccggccgtccggttcgttacgggtaagaaacgaccccgtaaagtaccctttacccaacccccgtttacaaaccgtaaaggaagtacgtaacggttaaacctttaacccggaaaaagttaaccccttacgttattttacggtactttttacccggagtagggtaaaacttaccggtaaaccttaaaaccccggttaaacggaaaaaacccggggacggtaaaaccgaacccgggggtacttaaaacggtttaggtttaaaacttttcggttttagggtttacgtttaacgggggtttccttttaaaagtacttaacggtaaacggtaaaacttccgtaccgtaaaccgggggtcggggttaaaacccgaaccccggggg

SEQ ID NO: 439211 - DNA, 677 bp, Homo sapiens
  misc_feature: GZ8MTXP02GYJLX.44.36.D03.1.454.CMB.2.raw
  modified_base (411)..(411): a, c, t, g, unknown or other
  modified_base (474)..(474): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgctaggttgggtggaggtccgggggatacgttggtccaggcctgggacgggtccctgacgctctcctgtcgtcgcctgtggacttcaccatcagtcgaccactatagtggacgtcgggcccacgaggcctaccggaggggaacggggtctagggagtgggccttcgggaccaaccgaaaagtaaaaaccaggttcacctagttactttanacacgaggacgtaccggccgtcgtactaggtacaaaacgccaagtacttcccgacccttcganaaagacgtatacggtaaacttcaaaagtacctgtaatttgaactttcgaggaactaagtaccgtaaccgttaaaaccaggggaaaaaaccccggtcggaaccggtacggtactaaaggtttaacgtttagttacgtttaggtttaggtttaagttaaccgtttaaatacgttacggtaaccggttaaccgttcgggtaacccg

SEQ ID NO: 439212 - DNA, 581 bp, Homo sapiens
  misc_feature: GZ8MTXP02JXNY7.44.36.D03.1.454.CMB.2.raw
  modified_base (379)..(379): a, c, t, g, unknown or other
  modified_base (467)..(467): a, c, t, g, unknown or other
  modified_base (501)..(501): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagcctggagggtccctgagactctcctgtgtcgcctctggattcaccatcagtgaccactatatggactgggtcccgccgaggcctccgaggggaaggggctggagtggctggccgaccaagtaaaaacaagttgaccagtctttancacagagtacgccgcgtctgtgaaacgcccaagacttcccaccctctacgaaagacgatacgacttacaaagaactcaattgattcgngacgaatcgaaccttaaaccgtagaaaaacccgnggaaccgacgggactaagtagttaactttagtttggttgtttggttagttttaacattacgaacggtaacttcgtacccg

SEQ ID NO: 439213 - DNA, 753 bp, Homo sapiens
  misc_feature: GZ8MTXP02G76EZ.44.36.D03.1.454.CMB.2.raw
  modified_base (293)..(293): a, c, t, g, unknown or other
  modified_base (329)..(329): a, c, t, g, unknown or other
  modified_base (725)..(725): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgttgttattttacaaggtgtccagagtgaagtgcaggttggtgggaggtccgggggatacgttggtccagccgtgggacggttccctgagtactctccgtgtgtcgcctcgtggattccaccntccagtcgaaccatatagtcggacctcggggtcccnccgaggcctacccgggaagggggaacggggtccttaggggagtcggggtacgttcggggacccaacgtaaacggttaaaaaaaccaacgggtttcgaacccgtaaggttaccctttttacgaccgaacgtaacggtaaccggttaccccggtcccggtacgttacccgtagggttaaacggaaaaccgtcccgtaaaggtaccctttaccccgaaaccccttcctaacgaaaacgtacgagttcgtaaactttacgaaaacgtaaccttccgtaaatttcggaatttacgacgtacgtaaattcggaaacccttaaacgtaacggaaaaacccggacggtaccggaaacggtccgtaatacgttaactttacgttggttgtttaagttacgtttanacgttaccaagggttacctcggtaccgg

SEQ ID NO: 439214 - DNA, 566 bp, Homo sapiens
  misc_feature: GZ8MTXP02JB0R6.44.36.D03.1.454.CMB.2.raw
  modified_base (223)..(223): a, c, t, g, unknown or other
  modified_base (311)..(311): a, c, t, g, unknown or other
  modified_base (361)..(361): a, c, t, g, unknown or other
  modified_base (371)..(371): a, c, t, g, unknown or other
  modified_base (392)..(392): a, c, t, g, unknown or other
  modified_base (413)..(413): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggagggtccctgagactctcctgtgtcgcctgtggattcaccatcagtcgaccactatatggacgtgggtcccncgaggcctccgagggaagggctggagtggctggccacagtaaaaacagtnacagtctttncacagagtacgcgcgtctganaaagccagacttccgaccctntacgaagagatgacttacgaaagtaacttcagttgaacttccgagcgtaaatcgaaacttaaccgacgaaaaaccggcggaaccgacggactagttacgttattagttgttagttaagttagtttaactacgtacgtaacggtactcgtaccg

SEQ ID NO: 439215 - DNA, 664 bp, Homo sapiens
  misc_feature: GZ8MTXP02GS15V.44.36.D03.1.454.CMB.2.raw
  modified_base (272)..(272): a, c, t, g, unknown or other
  modified_base (313)..(313): a, c, t, g, unknown or other
  modified_base (380)..(380): a, c, t, g, unknown or other
  modified_base (567)..(567): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagtacgttggtccagccgtgggacgggtcctgagactctctgtgtcgctngtatcaccatcagtcgaccactatagtggacgtcgggtccncgaggcctacggaggggagggctggagtgcgtggccacgaaagtaaaaacaagtcgacagtctttancaacgaggtacgtaccgcgtcgtcgtagtagaaaacgcccaaaggtacctttacccgaaccccttctaacgaaaggtagtatacgtaaacttacaaaacgtaaccttcaagtttcgaacttttccgaggtaaccgtaaagttaccgtaaaacccgttaaacccgaaaggaaaaaaacccccgggggnggtaaaacccggacgggtactaaagtttacgttaagtttacgttggtttagtttaagttacgtttaactacgtacgtaaacggtacttcgtacccgg

SEQ ID NO: 439216 - DNA, 794 bp, Homo sapiens
  misc_feature: GZ8MTXP02GDDVS.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggaggtccgggggagtacgttggtccagcccgtgggacgggtccctgacgtactctcctgtgtcgcctctgatcacctatcgagtcgaccactatagtggacgtcgggcccgtcgacggtcctaccggaagggggacggggtcgtaggggaggtcgggtccgttcggggaccgtaccgaaaacggttaaaaaaaccgtaacggtttacgaccgtaacggttacctttttacgaccgtaaacgacggtaacggtacccggaccccggtaccggttaccgttaggttaaacggaaaaaccgtcccgtaaacggtaacctttaccccaaaccccgttcctaacgtaaaaggagtaacttacggaaacctttacgaaaacggttaaaccttactaagtttacggaactttccgtagtaaccggtaaagtaccggtaaacccttaaaacccggtaacggaaaaacccgggtacggggaaaccggaaccggggtaacttaagttaggttttaaacttacgtttagggtttagtttaacggtttagtttaaattaccgtagtaaaccgggtaactccggtttaacccgg

SEQ ID NO: 439217 - DNA, 767 bp, Homo sapiens
  misc_feature: GZ8MTXP02G4K4Z.44.36.D03.1.454.CMB.2.raw
  modified_base (473)..(473): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggacggccctggagtggcttgcacacatcttctcgaatgaacgaaaatcctacagtacatctctagaagagactacgtttaaccatacctaccaaggacccaaccctaaccgaaaagggtcctaaggggttcggtttacctttaaggtacgttacggaaaccctaaactacgttaccgggaaccccttggacccggaccaacccgacggaccactaacttaacgtttaccgtagtcggaccgtaaacgggggtaacgtacggggaacggggaaaanaaaccgtagttacgttcggtttacgtagttaatttaacgtaaacgtttacttaaccgtagttacgtaggggtaccgttcgggtacgggggtaaccaaaaccgggggtaccctacgggtacccgtaacccggttccttaccccgtaccgtacggtccccttaccggaaaccccggtacccgggtacccgtccggttcccgggtccccctttcccccgggtcggaccccgtccccgtccgtccctaccgacggaaccgtcccgtaccggtccgggacggccaccggccggccccgg

SEQ ID NO: 439218 - DNA, 708 bp, Homo sapiens
  misc_feature: GZ8MTXP02GQHPF.44.36.D03.1.454.CMB.2.raw
  modified_base (437)..(437): a, c, t, g, unknown or other
  modified_base (507)..(507): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacaaggtgtccagagtgaagtgcaggttggtggaggtccgggggagtacgttgggtccaggccgtgggacgggtcccctggacgtacctctcctggtcgtccgtcctctggattcaccatcagtcgaaccactatagtggacgtcgggtcccgcgacggctccggaggggaaggggcgtggggaggttcggggcgtttcggggaccgaccgtaaaagtaaaaaaccgtaaaggttcgaccctaaggtaccttttanccaacgtagaacgttaccgcccgcgttcgtaggttacgaaaacgtcccgaagtacttacccacccccttntaaccaaaggagtactacgtaaacctttacggaaaactaacttctaagtttacgtaactttcctaggacttaaacgtacgtaaaccctaaaccgtaacggaaaaaccgacgggaacgaaccggggactaacgttagttaacttttagttcgtttagtttaagtttacgtttaatacgtacgtaaggtaacctcggtacccg

SEQ ID NO: 439219 - DNA, 636 bp, Homo sapiens
  misc_feature: GZ8MTXP02I14NU.44.36.D03.1.454.CMB.2.raw
  modified_base (220)..(220): a, c, t, g, unknown or other
  modified_base (390)..(390): a, c, t, g, unknown or other
  modified_base (439)..(439): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacgaaggtgtccagagtgaagtgcaggttggtggaggtccggggganacttggtccagccgtgggacgggtccctgagctctccgtgtgtcgcctgtggattcaccatcagtcgacctatatagtggactcggggtccgccaggcctacggaggggaaggggctgggagtcgggtcgttggcccgataaagtaaaaacaagttccgaccagtcttancacagcgtaccgccgcgtctggtagaaaggcccaagtacttccaccctntaccgaagagatgaacttagaaagtacttactagtttgaactttcgtacgacgtaaactacgtaaaccgtaaacccgtagggaaaaacccggtggaaaccgacgggactaaagttgttaaatttagttcggttgtttgttactttatacgtcgaacggttaactcggtaccgacggtaccggggaccgtaaaccggg

SEQ ID NO: 439220 - DNA, 602 bp, Homo sapiens
  misc_feature: GZ8MTXP02JON27.44.36.D03.1.454.CMB.2.raw
  modified_base (397)..(397): a, c, t, g, unknown or other
  modified_base (410)..(410): a, c, t, g, unknown or other
  modified_base (504)..(504): a, c, t, g, unknown or other
  modified_base (548)..(548): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggccagcctgggaggtccctgagactctcctgtcgtcgcctctggattcacatcagtgaccactatagtggacgtgggtcccgccgagggctccgaggggaaggggcgtgggaggtgggcgttggccgacaaggtaaaaaacagttcgaccagtcttatcacagcgtacgccgngtctgtagaaacnccagacttccaccctatcaagacgtatcgtaactcaaagaaccttacagttgtaatcgtagacgtaatcgaacctaaaccgtaggaaaacccgnggaacgacgggatactgttattggttagtgtttgttattttaanacgtaagtaacggttaactcgttaccgacgttcgggggaccgttaaacccgggg

SEQ ID NO: 439221 - DNA, 737 bp, Homo sapiens
  misc_feature: GZ8MTXP02IJIMA.44.36.D03.1.454.CMB.2.raw
  modified_base (225)..(225): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacgttggtccagcctgggacggtcctgagtactctcctgtgtcgcctctggacttcaccatcagtcgaccactatatggactggtccgcgaggctaccggaggggaacgggctagggagtcggcgttcgggccgacgtaaaagtaaaaaccgaaaggttcgacctaagttcctttagtaccaacgaaggtaacgtaccggccgtcgttacgtggtaacgaaaacgccgtaagtactttacccgacccttcgtacgaagtaagtacgtcgtaaacctttacgaaaacgtaccttctaagtttcgaactttcgaacgtacgtaaagttaccggaaaccttaaacccggtaaacggaaaaaccccggtacggggtaacgaaacccgggggtacttaaaggtttaacgtttacgtttttaaacggttttcgggtttacgggtttttaagttttaacggtttttaaattaaccgttaacggtaacgggtttaaaaccgtttccggtaaaaccccggg

SEQ ID NO: 439222 - DNA, 635 bp, Homo sapiens
  misc_feature: GZ8MTXP02JW41S.44.36.D03.1.454.CMB.2.raw
  modified_base (274)..(274): a, c, t, g, unknown or other
  modified_base (285)..(285): a, c, t, g, unknown or other
  modified_base (400)..(400): a, c, t, g, unknown or other
  modified_base (469)..(469): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtctgggttttccttgttgttattttacaaggtgtccagagtgaagtgcagttggtgggaggtccgggggagacttggccagcctgggagggtccctgacgactctcctgtcgtcgcctntggattcaccntcagtgaccatatagtggacgtcgggtcccgcgaggcctccggaaggggacggggcgtgggaggtggcgttgggacccgacgaaaacgtaaaaacgaagttcgaccagtctttanccgaacacggtacgtaccgcccgtcgtctagtaacgaaaacgccctaagtaccttcccgaccccctttnaaccgaaagtacgacttacgtaaaccttacaaagtaccctagtattcgtaacttctagaccgtaatacgtaacctaaacgtacgaaaaccggtaggaccgagggctaagtgtttaattagtttgttagttcgttaagtttctaagtgtaacggtacttcgtaccgg

SEQ ID NO: 439223 - DNA, 679 bp, Homo sapiens
  misc_feature: GZ8MTXP02HHF0R.44.36.D03.1.454.CMB.2.raw
  modified_base (329)..(329): a, c, t, g, unknown or other
  modified_base (368)..(368): a, c, t, g, unknown or other
  modified_base (403)..(403): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggagtggcttgcacacatcttctacgaatgaacgaaaatcctaacagtacatctctgaagagcagtttaaccatctacaagacacctacaaaggcaggtgtctttagtatcgaacctaaanatcggacctggaccggacaccgaggcaacattacttacngtgacgtaagggtaatggaaccgggaaaagaaacnggtactggtttactgtaattaactaagttacttaacatacgtcggacgtcgtaggggacgaaaacggggaccaacgggtcctaacccggtcctcctacgtacgtaccgttacccgaaccgaacggggcccctaacggttcccggggttcccctttaccccccgggttcggtcccccggacccgttccggacccgttaccccggaagggggaaacccttcccgaaaccccggtttcgggcccggggggtaccaaacccgggacggggtcccccgggg

SEQ ID NO: 439224 - DNA, 706 bp, Homo sapiens
  misc_feature: GZ8MTXP02IQ00Q.44.36.D03.1.454.CMB.2.raw
  modified_base (318)..(318): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccgggggagacgttggtccagccgtggacgggtccctgagactctcctgtgtccgcctctggacttcaccatcagtcgaccactatatggactcggggtcccnccgaggccgtaccgaggggaacggggcgtagggaggtcggtcgttcggacccgtacaaaacggttaaaaaacaagggttcgaccctagttaccttttagtccaaacgtaggaccggttaaccgcccggtccgttacgtcggtaaacgaaaggtccccaaggtaacctttcccaaccccttctaacgaaacgtagtactacggtaaacctttaacgaaaacgtaaccttacgtatttaggaactttcgtagaacgtaaactacggtaaacccttaaaccgtaaacggaaaaacccggtggaaaccgtacgggactaaaggttaggttactttacgttggttattaacggtttagttaacgttgtaacgtacggtaactttcggacccgg

SEQ ID NO: 439225 - DNA, 611 bp, Homo sapiens
  misc_feature: GZ8MTXP02HSO8M.44.36.D03.1.454.CMB.2.raw
  modified_base (373)..(373): a, c, t, g, unknown or other
  modified_base (376)..(376): a, c, t, g, unknown or other
  modified_base (379)..(379): a, c, t, g, unknown or other
  modified_base (386)..(386): a, c, t, g, unknown or other
  modified_base (389)..(389): a, c, t, g, unknown or other
  modified_base (396)..(396): a, c, t, g, unknown or other
  modified_base (416)..(416): a, c, t, g, unknown or other
  modified_base (558)..(558): a, c, t, g, unknown or other
tcagacagtatatacacgaccggtgctcgatttagctgcgtcacgatctctcttgggggagagcggagccccagccccagaattcccaggtgttttcattttggtgatcagcactgaacacagaggactcaccatggagttcgggctgagcgtggtttctgttagttatttacaaggtgtcagagtgaagtgcagttggtggaggtccgggggagacttggtccaggcctgggaggtccctgagactctcctgtgtcgctctggatcaccatcagtgaccactatagtggactgggtccgccaggctccgaaggggaggggctagggagtgggcttgggccgacaagtaaaaacaagttcgacagtctttaancanagngacgcgngtntgagaancatactaccacctcacaagngatgtaactacaaagtactactattacgtactttacgagacgtaagtacgaaaccttaaaccgtaaacggaaaaccggaggaaccgaaccgggtaactagttagtttaagtttagtttggttagttttgttagtttttaaanaccgtaacgtaaggtacttacggtacccgtcggtaccgggggtaccaacgggg

SEQ ID NO: 439226 - DNA, 984 bp, Homo sapiens
  misc_feature: GZ8MTXP02JA6W1.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttatttacaaggtgtccagagtgaagtgcaggttggtggaggtccgggggatacgttgggtccaggtccgtgggacgggtccctggacgactctcctgtcgtcgctctggattcacatcagtcgaccactatagtacggacgtcggggtcccaccgacggcctaccgggaagggggaacggggtcgtaggggtaacggttcggggtaccgttcggggacccgaacgtaaaacgggttaaaaaaaccgtaaaggtttaccggacctaacggtacctttttaacgaccgtaaaccgtaacgggaaccgggtttaacccgccccggttaccgggttacccgttttaaagggggaaacgtaaaaacccggccccgtaaaagggttaacccgttttacccctaaaccccccggttaccttaacccggtaaaaagggaaacgttaaaccggttaaccgggttaaaccctttaaccgaaaaaaccggttaaccctttaaccgttaagttttacgggttaaaacccttttccggtaacgggtaaaccccggttaaaagtttaaaccggtaaaacccccgttttaaaacccggtaaaaacggggtaaaaaaaccccccgggtaaaagggggaaaccccggttaaaacccggggggaaacccttaaacggggttttaaacgggtttttaaaactttttaaaacgggttttcggggttttaacggtttttaaccgggtttaggtttttttaaaactaaaccggtttaacccggtttaaaaccggggttaaacccggttttaccggtttaaaacccccggggg

SEQ ID NO: 439227 - DNA, 749 bp, Homo sapiens
  misc_feature: GZ8MTXP02IOFJP.44.36.D03.1.454.CMB.2.raw
  modified_base (348)..(348): a, c, t, g, unknown or other
  modified_base (457)..(457): a, c, t, g, unknown or other
  modified_base (703)..(703): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctggttctctctcaacgatattagaatgggtgtgagctggatccatcacgccccgagggacggcctggagtgcttgcacacatcttctacgaatagaacgaaaatcctaacagtacatctctagaagagtctaagttaaccatcctaccgaacggaccacctaaccgaaaaggcgtaggttcggttatttaagtacgtacgaaccctaanacgtaccgacccgtggaccggacctacgacggaccactacttattacctggtacgacggtaacgggtaatcggggaacgggaaaagtaaccgagtacgttacggttttntaaggttaactttaagttaaacgtttcctaaccttagttacgtacggacgtttcggtaacggggaacggtaaaaccgggtacccgtaaccgggttccgtaaccccggttccctaccgtacgtacccgtaccgttacccgaacccgggtaaaccgggtcccttacggttacccccggtttcccctttacccccgggcgggtaccccggttacccccgtcgtacccgttaccggaacggggtaacccncccgtaacccgggttcgggaccggggtacccaaacgggccccgggg

SEQ ID NO: 439228 - DNA, 785 bp, Homo sapiens
  misc_feature: GZ8MTXP02GT1RC.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggacggcctggagtggcttgcacacattcttctacgaatagaaacgaaaatcctaacatacatctctagaagagtactaacgtttaaccatacctaccgaaacggtaacccaaccctaaccgaaaagggccgtaagggtcggtttaacttttaggtactacgaaccctaaacgtacgtaccggtaccccgtggaccggaacaaccccgagggacctaactaagtttacgttaccgttaggtccggaacgttaaacgggggtaagtacggggaaacgggggaaaacgtaaacgtacggtacgtttacggttttacggttatttaaagtttaacttaacggtttaccttaaccctagttacgttcggggtacgttacgggtacgggggaaaccgtaaaaccgggggacccgtaccgggttaacccgtcccggttcctacccgtcgtaaaccgtcccgttaaccgaaccccgtaaggggtacccctacggttccccgttacccgttcccccggtggacccctcccgttcgacccctaccggagaaccgtcccggtaaccgttcgggccggggaaccaccggacggtcccgg

SEQ ID NO: 439229 - DNA, 661 bp, Homo sapiens
  misc_feature: GZ8MTXP02GQMAX.44.36.D03.1.454.CMB.2.raw
  modified_base (273)..(273): a, c, t, g, unknown or other
  modified_base (373)..(373): a, c, t, g, unknown or other
  modified_base (416)..(416): a, c, t, g, unknown or other
  modified_base (423)..(423): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctgggatccgtcacgcccccgagggaaggccctggagtggcttgcacacattcttctacgaatagaacgaaaactcctacagtacatctctagaaganctagttaaccatctaccgaagaccacctacaaaggcaggtgttctttagtatacgaaccaatagtccggaccctggacggaacaccgacgacaactaatnttacgtgtcggaccgaaagggttaagtaggaacggggtaaaanaaaccgnggtacgttacgggttttactagttaactttaaagttaacgttaccttaacctagtacgttgggtacgtcgggtacggggaacgtaaaacgggtaccgaccgggttaccacccggttactcccgtacgacgtcccttaccgaaccgtaaccgggccctacgtccggttccctcccggttcgaccgcccgtcgtaccgccgaagtcgacctccgtcggacggggaccacggacggcccgg

SEQ ID NO: 439230 - DNA, 760 bp, Homo sapiens
  misc_feature: GZ8MTXP02FJFEQ.44.36.D03.1.454.CMB.2.raw
  modified_base (513)..(513): a, c, t, g, unknown or other
  modified_base (621)..(621): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggagtccgggggagacttggtccagccgtgggacggtccgtgacgtactctccgtgtcgtcgtcctgtggtacttcacctatcgagtcgacctactatagtacggtacgtcgggtcccgaccgacggtcctaccggaagggggaacgggtggtcgggtagggtcgggtcggttcgggacccgaagtaaaagtaaaaaaccgtaaggtcccgacgtacttactttaacacaacgaacggtacgtacccgccggtacgtcgtagtaagaaaccgtacgaagttacctccccgaaccctctaaacgaagtanacgttaccgtaaacttaccgaaaacgtaccttagttagtttactactttcgacggtaacgttaagtaacccgtaaaaccttaaaccggaaacgggaaaaaccccgggngaaaccgggtacgggtataacgttagttaaaatttcggtttggttaacgtttgggtttaaattaggttaacctaacgggtaacgttaacgtaccccggtacggtacggggtcccgggggaaaccgttaaacccccgggg

SEQ ID NO: 439231 - DNA, 674 bp, Homo sapiens
  misc_feature: GZ8MTXP02FP171.44.36.D03.1.454.CMB.2.raw
tcagacagtatatacacgaccggtgctcgatttagctgcgtcacgatctctcttgggtcttgtcccaggtcaccttgaaggagtctggtcctgtgctggtgaaaccccacagagacccctcacgctgacctgcaccatctctgggttctctctcaacgatattagaatgggtgtgagctgatccgtcagcccccaggaagccctggagtggcttgcacacatcttctcgaatgaacgaaaatcctacagtacatctctgaagagcaagtttaaaccatctaccaaggacaccctcaaagcaggtggtcttagtatgaccaacatggaccctgcggacaccaggcacatattactgtgccgaacgggtaaatgacgggaaaacgaaaacagtacttaggttttaccttagttaattaattaaagttaccttaaaccctaacttacgtggaaccggttccggtagggggtaccaaaaacgggggtaccccaaaccggggttccctaaaccccgggttccttcccccttacgaacgtccctttaccccaaacccgaaaccggggccccaacgttcccgggttcccctttcccccccgttcggccccggcccccttcgcccgttcccgaacggaacgacccgaacccgttcgcgggggaccaaccgacggcccccggg

SEQ ID NO: 439232 - DNA, 649 bp, Homo sapiens
  misc_feature: GZ8MTXP02HD41N.44.36.D03.1.454.CMB.2.raw
  modified_base (293)..(293): a, c, t, g, unknown or other
  modified_base (325)..(325): a, c, t, g, unknown or other
  modified_base (521)..(521): a, c, t, g, unknown or other
  modified_base (536)..(536): a, c, t, g, unknown or other
  modified_base (619)..(619): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgtttgtttattttacgaaggttgtccagagtgaagtgctaggttggtggaggtccgggggagtacgttggtccagccggtggacgggtccctgagctctctgtgtcgcctctggacttcacntcagtcgaccatatagtcggacgtcgggtccncgaggcctcggaggggagggcgtgggagtggtcgtcggccgacgaaaagtaaaaacaagttcgacctaagtactttagcctaacgaaggtacgtaccgcccgtacgttacgtagtaacgaaaccgccctaagtacctttcccgaacccccttctaacgaaagtagtaactcgtaaacttaccaaaagaccctttanatttggaactttcgngaaccgtatacgaaccttaaacgaagaaacccggagtacgacgggactagtagttacttagttggttagtttcggtattttanaacgttcgtaaaggtaccttggtaccccgg

SEQ ID NO: 439233 - DNA, 675 bp, Homo sapiens
  misc_feature: GZ8MTXP02JE9HY.44.36.D03.1.454.CMB.2.raw
  modified_base (247)..(247): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaagccctggagtggcttgcacacatctctcgaatgaagaaaatcctaanagtacatctctgaagagcaatttaaaccatctaccgaaggaccaacctaccaaaaggccaggtcgggttactttaaggtatacgaacccaaactagtcggaaacccctggaccggaacaccgagggacaactattacttaaccttggtcgaacgtaaacgggggttaaatacgggaaaccggggtaaaaaggaaaaccgtagtaccgttaggtttcgtagttattaaagttaacgtacttaccattcgtacggtacgtcgtaggggacgaaacgggaccgtaccggtaccgtaccgtacccttcccgtacgaacgtccgttacccgaccgtaaccggtcccgtaacgtcccgttcccgtttcccccgccgggcctccccgtcgcctccgacgaacgtcccgaccgtcggcggggccaacgcggcccgg

SEQ ID NO: 439234 - DNA, 793 bp, Homo sapiens
  misc_feature: GZ8MTXP02FX4HP.44.36.D03.1.454.CMB.2.raw
tcagacagtatatacacgaccggtgctcgatttagctgcgtcacgatctctcttggggagccctgagagcggagccccagccccagaattcccaggtgttttcatttggtgatcagcactgaacacagaggactcaccatggagttcgggctgagcttgggttttccttgttgttattttacaggtgtccagagtgaagtgctaggttggtgggaggtccgggggagtacgtttgggtcccaggtcccgtgggacgggttcccctggagtacctctccctgtgtccgcctcgtggattcaccatcagtcgaaccctactatagtcggacgtcggggtcccgccgacggcccgtccggaaggggtaacggggccgtaggggtaggttcgggcgtttcgggcccgtaacgtaaaacggtaaaaaaaccgtaaagttacggaccccgtaaggttaccttttaagtccgaacgaaacggtacggttaacccgcccggtacgtttacgtcgggttaaacgaaaacggccctaaaggtaccttacccgtaaacccccttcgtaaccgaaagggtaactacgttaacgtaaacctttaaaccgaaaacggttaaaccttacgtaagtttaggttaacctttacgttaccgaacgttaaaacgtacggtaaaacccttaaaccggtaaacggaaaaacccggtacggaaaacgaccggaataacgttaagtttaagtttacgtttcggttgttttagttcgttttaaagattacggtaaggtaactcggtaccgtaaccgg

SEQ ID NO: 439235 - DNA, 601 bp, Homo sapiens
  misc_feature: GZ8MTXP02IX66J.44.36.D03.1.454.CMB.2.raw
  modified_base (225)..(225): a, c, t, g, unknown or other
  modified_base (274)..(274): a, c, t, g, unknown or other
  modified_base (415)..(415): a, c, t, g, unknown or other
  modified_base (462)..(462): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacgttggtccagccgtgggagggtccctggagctctcctgtgtcgcctntggattcacatcagtcgaccactatatggacgtgggtccgccgaggctccgaggggaaggggctgggagtggcttgggcccgacgaaagtaaaaaacgaagttcgaccctagtctttatcacagacgttaccgccgtcgtntgtagaaagcccaagcttaccaccctctacgaagagatgaaccttanaaacgaacttcatttggaactttccgaggaactaagtacgaaccttaaaccgaggaaaaaccccggaggacgaccgggactaagttcgttaattagttgttagttcgttagtttactacgtacgaaggtactcgtaccg

SEQ ID NO: 439236 - DNA, 690 bp, Homo sapiens
  misc_feature: GZ8MTXP02GFWUK.44.36.D03.1.454.CMB.2.raw
  modified_base (217)..(217): a, c, t, g, unknown or other
  modified_base (341)..(341): a, c, t, g, unknown or other
  modified_base (372)..(372): a, c, t, g, unknown or other
  modified_base (486)..(486): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccggggganacttggtccagcctggacgggtccctgagactctctgtgtcgcctctggattcacatcagtgaccactatatggactgggtccgcaggctccgaggggaagggctgggagtggcttgggccganaaaggtaaaaacaagttccgccagtctttancaacaggacgtaccgccgtgtctaggtagaaaacgtcccaagtactttcccaccctctacgaaagagacttgaaccgtttacaaaacgtaacctgtaagttgtaaactttccgngggtaacccgtaaaattcggaaaacccttaaaccgttacgggaaaaaaacccggaacggggtaaccgaaccgggggacctaaacgttacggttaatttaaacgtttcggttaagggtttgtttaaccgtttaagttaacgtaacgtaaaggggtaaacccttcgggtaacctacggtaacggggggtaccctaaaacccggggg

SEQ ID NO: 439237 - DNA, 922 bp, Homo sapiens
  misc_feature: GZ8MTXP02IIG2V.44.36.D03.1.454.CMB.2.raw
  modified_base (220)..(220): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcggctgagcttgggttttccttgttgtttattttacaaggtgtccagagtgaagtgcagttgggtggaggtccggggganacgttggtccagccgtgggacgggtccctggacgtacttctccgtggtcgtccgccttcgtcggtattccgaccatcgaagtcgaccctactaatagtacgggtacctacggggtccccgaccgagggtcccgtaccggaacggggggtaaggggtcgtaggggaacgggttgggtccggtttacggggccccgtaaacgtaaaacggttaaaaaaaaccgtaacggtttacccggaacccccgttaaggttacctttttaaaacgccgtaaaccgaaacgggtaccggggttacccgacccgggtaccggtttaccgttacggtaacggaaaacggtaccctaacggtaccttaccctaaccccgttaccgtaacggaaacgtaaacggttacgttaacggtaaccctttaaacgaaaacgttaacctaacgttaacgtttacggttaactttccgtaacggggtactaaacggttaaccgtaaaacccgttaaacccgaaaccgggtaaaaaccccggggaacggttaaccggaaccggggtaacttaacgggtttaacgtttaaagtttacggtttaaacgggttttcgtttaacggggtttaagtttttaactaaacgttaacccgtaaacggggtaaaacctttcggtaaccccggtaccggtttaccgggggggaacccctttaaaaccccggggg

SEQ ID NO: 439238 - DNA, 867 bp, Homo sapiens
  misc_feature: GZ8MTXP02H8J14.44.36.D03.1.454.CMB.2.raw
  modified_base (283)..(283): a, c, t, g, unknown or other
  modified_base (328)..(328): a, c, t, g, unknown or other
  modified_base (414)..(414): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcgttgggttttccttgttgttattttacgaaggtgtccagagtgaagtgctagttggtgggagtccgggggagtacgttggtccaggccgtgggacgggtccctggacgtactctctgtgtcgcctntggattcaccatcagtcgacctactatgtcggacgtcgggtcccnccgaggcctaccggaggggaacggggctgggagtggtccgttggccgacgaaagtaaaaacctaagttcgaccctagtacttttanccgaacgtaaggtacgttaccggcccgtcgttcctaggtacgaaaacgcccgaagtaccctttacccaacccccttcttaaccgaaaggtaaccgtagtacgtaaaccttttaccgaaaacggtaaaaccctttacgttaaacgtttacgtaacgtttaccgaacggtaacgttaaaacgttaaccggtaaaacccgttaaaaccccggtaaaacgggtaaaaaacccccgggtaacgggtaaaacccgggttaaacccggggttaaacgtttaaacggttttaaacgggtttttaaaacgtttttaaacgggttttttacggggtttttaacggggttttttaacgggtttttaaaacggttttttaaaaccgttaaaccgggttttaaacccgggttaaaaccggggttttaaaacccccggtttaaacccgggggtttaaacccccccgg

SEQ ID NO: 439239 - DNA, 786 bp, Homo sapiens
  misc_feature: GZ8MTXP02IR072.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcaatgaacacagaggactcaccatggagttggggctgcgctgggttttccttgttgctattttagaaggtgtccactgtgaggtgcggctggtggagtcgtgggggaggtcttgggtacgaggggcgggggggtcccctggacgtactccgttcccgtggtcgctacgccctcgtggattcatcttcagtgactatcgcctagtggaacgttcggggtcccgccgacgggtcccgtaccggaagggggaacggggtcgtgggtaacgggtttcggggtttacctagtttagttagtttaaaattgtttcggacgttggggtaaatacctaacccgtaacccgttaacgttacgaccgtacgacgtttccgtaggttacgggaaacgggtcccgtaagttacccgtaacccgtaaacgtttcccggaaaaggggaacctaaaggtaccgaaaaccccgtaaacggtaaaccctttaccgtaacctttaggttaaaccgttccggttaaaagggggtaaaacttacggaaaacgttcgaacccgttagaaacgggtaaacggaacccggggaaacggtaaccggtaacgggtccgttcgtttaaccgttacgtttaccgttaaggttaccggtaggtacgtaacgggttcccggtacccggtttaagtttcggg

SEQ ID NO: 439240 - DNA, 688 bp, Homo sapiens
  misc_feature: GZ8MTXP02IB2VS.44.36.D03.1.454.CMB.2.raw
  modified_base (332)..(332): a, c, t, g, unknown or other
  modified_base (529)..(529): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttggtggaggtccgggggatacgtttgggtcccaggccgtgggacgggttcccctggagacctctcctgtcgtccgcccctggacttcaccagtcagtcgacccactatagtggacgtcgggtccnccgaggcctcggaggggaggggctgggagtgggccgttgggcctacgaaacgtaaaaacgtagttcgaccgtagtactttatccagagtaacgtaccgccgtcgtcgtagtagaaacgcccgaagtacttccacccctctaccgaaagacgtatacgacttaacaaaggtaaacctctaagtttagtacgtttaccnggtaaaccgtaattcggtaaaaccccttaaaccgtaaacgggaaaaacccggacgggaaaacccggacggaacctacgttaggttaaacttttacgttacggtttcggtttagttaagttttataacgtaccgaaagttaccgtgtaccccgtacgggg

SEQ ID NO: 439241 - DNA, 633 bp, Homo sapiens
  misc_feature: GZ8MTXP02H30F5.44.36.D03.1.454.CMB.2.raw
  modified_base (209)..(209): a, c, t, g, unknown or other
  modified_base (268)..(268): a, c, t, g, unknown or other
  modified_base (277)..(278): a, c, t, g, unknown or other
  modified_base (282)..(282): a, c, t, g, unknown or other
  modified_base (289)..(289): a, c, t, g, unknown or other
  modified_base (302)..(302): a, c, t, g, unknown or other
  modified_base (345)..(345): a, c, t, g, unknown or other
  modified_base (432)..(432): a, c, t, g, unknown or other
  modified_base (442)..(442): a, c, t, g, unknown or other
  modified_base (605)..(605): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggnggagtccgagggagacttggtccagcctgggacggtcctgagactctcctgtgcgcctnggatcacannagtnaccatanatggactggcccncgagctccgaaggggagggctgggagtcggcgttggccccganaaaacgtaaaaacaagttgaccctagcctttaagacacgagaacgtacgccgcgtctggaagaaaacgtccaagtcttaccaccctntacgaaaagngtaatctaactaacaaagtaacctctattagacgttcgtaagaacgtaataccgtaaaccgtaaaaccgtaaaacggaaaaaccgggaacggaccggaaaacggtacctaaagtttaggttaaacttaaccggttggttaagttttagttaaccgttttaaanaccgtaaccggtaaacggtaacctcggg

SEQ ID NO: 439242 - DNA, 566 bp, Homo sapiens
  misc_feature: GZ8MTXP02GEJTJ.44.36.D03.1.454.CMB.2.raw
  modified_base (186)..(186): a, c, t, g, unknown or other
  modified_base (222)..(222): a, c, t, g, unknown or other
  modified_base (306)..(306): a, c, t, g, unknown or other
  modified_base (337)..(337): a, c, t, g, unknown or other
  modified_base (351)..(351): a, c, t, g, unknown or other
  modified_base (362)..(362): a, c, t, g, unknown or other
  modified_base (380)..(380): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtntcagagtgaagtgcagttggtggaggtccggggganacttggtccagccgtggaggtccctgagctctcctgtgtcgcctctggattcaccatcagtcgaccatatatggactgggtccncaggctcgagggagggctggagtgctggccnaagtaaaacagttnccagtctttancaacgagacgtaccgcgngtctgtagaaacgacagacttccaccctctacgaaagacgatgtaacttacaaacgtaactactattagtattcgtgacgaatacgaactaacctaacgaaaccgaaaaaacggcgaacgggactagtagttagttaagttgttgttaagtttagtttaacttagtacgtacgtacgtacgtaccg

SEQ ID NO: 439243 - DNA, 736 bp, Homo sapiens
  misc_feature: GZ8MTXP02I4B2U.44.36.D03.1.454.CMB.2.raw
  modified_base (635)..(635): a, c, t, g, unknown or other
tcagacagtatatacacgaccggtgctcgatttagctgcgtcacgatctctcttgggagctctcagagaggtgccttagccctggattccaaggcatttccacttggtgatcagcactgaacacagaggactcaccatggagttgggctgcgcgttgggttttccttgttgtcttattttagaaggtgtccagtgtggaggtgcgggctgggtggaggttcggtgggggaggtcgttgggtaccgacggggtccggggggggttcccctggacgtactcttcccgtggtcgcacgccctgtggtacttcattcttcagtcgtactagtcgacctagtacgaaccgtccggggtcccgcgaggccctaccgggaaggggacggggtcgttagggaggtttcgggtttacaagttgttagtttaattagttcggtacgtggggaagtacgttacccctaaccgttaccgtaacgcgtaacggtaacctggttaacggtaggaaaccggggtcccttaacgttacccaaacccccgttaatttcccggaaagggtaaacaacttaccggaaacccctaaagtaaccccgttactaacggtttgtaaacttaaccggtagggtaaaatccggaaaacgngttaccgagggaagaccggaaacgaggacccgtaccggtgtttacgtccttacgtttcgtaaggtacgacggtagaccggtcccggtacgttaggtttcgg

SEQ ID NO: 439244 - DNA, 831 bp, Homo sapiens
  misc_feature: GZ8MTXP02F8AYH.44.36.D03.1.454.CMB.2.raw
  modified_base (382)..(382): a, c, t, g, unknown or other
  modified_base (419)..(419): a, c, t, g, unknown or other
  modified_base (506)..(506): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttggttttccttgttgttattttacaaggtgtccagagtgaagtgcaggttgggtggacgggtccgggggagtacgttggtccaggccgtggacgggtccctagagtactctccgtgtcgtcgcctctggacttccaccatcagtcgacccatagtagtcggacgtcgggccgccaggcctaccggaggggaacggggctaggggagtcgggcttgggacccgtanaaaagtaaaaaccgtaagttcgccaagttactttacnccgaaacgtaggtaacgttcccgcccggtcttcgttaacggaggaaaaccctcccgtaaacggtactttaccccgaccccttcgtanaaacgggtataacgtgtaaaccctttagaaaacttacctagttagttacgttaattccgacggtaacgtaaaacgtttacgggaaaccccctttaaaaacggggtaaacccggaaaaaacgggggtaacgggtaacccccaacggggggttaaacttttaaaacggtttcgggggttttttaaaactttttagggggtttacgggttttttttacggttttaacgggggttttttaaaaccccgttttaaaacgttttttaaacgggacccggggtttaaaaaaaaccggggtttccctttttaaccggggtttacccccggggg

SEQ ID NO: 439245 - DNA, 800 bp, Homo sapiens
  misc_feature: GZ8MTXP02IOJ1B.44.36.D03.1.454.CMB.2.raw
  modified_base (279)..(279): a, c, t, g, unknown or other
  modified_base (321)..(321): a, c, t, g, unknown or other
  modified_base (764)..(764): a, c, t, g, unknown or other
tcagacagtatatacacgaccggtgctcgatttagctgcgtcacgatctctcttggggagctctgagagcggagccccagccccagaattccccaggtgttttcatttggtgatcagcactgaacacagaggactcaccatggagttcgggctgagctgggttttccttgttgttattttacaaggtgtccagagtgaagtgcagttggtggaggtccgggggagtacgttggtccaggccgtgggacgggtccctggagactctcctgtcgtcgcctntggacttcaccatcagtgacccatatagtggacgtgggtccncgaggctccggaggggaacgggcgtgggagtcgggcgttcggggaccgacgtaaaacggtaaaaaaaccaaggtttcggaccctaaggttactttttacaccgaaacgtaaagggtaccgttaacccggcccggtacgttcccgtaaggttaaccgaaaacggtcccccgtaaaggtaaaccttttccccgaacccccctttacgtaaaccgaaaaaggtaccgggtaaatacggttaaacctttaaccgaaaaacggtaaacccttcgtaaatttagggtaactttaccgtggtaaaaccgtaaattacggtaaaacccctttaaaacccgaaacgggtaaaaaaacccggtacggggaaaaccgtaaaccggggtcgtaaaacgttcgtttaaacgtttaaacggtttgtttaagggtttgtttaaggtttaaacttttanaacggttaaccgttaaaccggttacgtaaccccggg

SEQ ID NO: 439246 - DNA, 673 bp, Homo sapiens
  misc_feature: GZ8MTXP02HIM0F.44.36.D03.1.454.CMB.2.raw
  modified_base (278)..(278): a, c, t, g, unknown or other
  modified_base (282)..(282): a, c, t, g, unknown or other
  modified_base (323)..(323): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggttgtccagagtgaagtgcaggttggtgggaggtccgggggagacgttggtccaggccgtgggacgggtccctgagtactctcctgtgcgcctntggnttcacatcagtcgaccatatagtggactcgggtcccaccgnggcctaccggaggggaacggggcgtgggaggtggcgtcgggaccgacgaaagtaaaaacaaggttcgaccgtagtctttatcaacgagtacgtaccgccgtacgtcgtgtagaaacgccgtaagtacttacccgaccctacgtaccaaagtagagttactaaccttaacgaaagttaacctactagttagtacttaccgtaggtacgaaatacgtaaaccttaaccgtaaacggaaaaacccggaggtaaccggaacggtactaagttgttaacgtttaacgtttggttggttttaaggttaagttttaacgtacgttaacgtaacggttaacccgtttcggtaacccgg

SEQ ID NO: 439247 - DNA, 607 bp, Homo sapiens
  misc_feature: GZ8MTXP02FI53I.44.36.D03.1.454.CMB.2.raw
  modified_base (219)..(219): a, c, t, g, unknown or other
  modified_base (267)..(267): a, c, t, g, unknown or other
  modified_base (309)..(309): a, c, t, g, unknown or other
  modified_base (386)..(386): a, c, t, g, unknown or other
  modified_base (444)..(444): a, c, t, g, unknown or other
  modified_base (451)..(451): a, c, t, g, unknown or other
  modified_base (486)..(486): a, c, t, g, unknown or other
  modified_base (495)..(495): a, c, t, g, unknown or other
  modified_base (566)..(566): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggtggaggtccggggganacttggtccagcctgggacgggtccctgagactctcctgtgtcgcctntggattcaccatcagtgaccactatagtggactggggtcccncgaggcctaccgaggggaagggctgggagtgggcttgggccacgaaagtaaaaactaagttcgaccctagtctttanccaacgagtacgtaccgccgtcgttcgtgtacgaaacgccagtactttcccacccttnacaaagngattcgaacttcaaaagtacttcaattgacttcgngaccgtaancgaaacctaacgtaggaaaaccgtggaacctagggctaagttggtatttagttgtagttcgttagttatancgaaggtaacttcggacctacggtcggggacctaaacgggg

SEQ ID NO: 439248 - DNA, 602 bp, Homo sapiens
  misc_feature: GZ8MTXP02F510A.44.36.D03.1.454.CMB.2.raw
  modified_base (294)..(294): a, c, t, g, unknown or other
  modified_base (321)..(321): a, c, t, g, unknown or other
  modified_base (326)..(326): a, c, t, g, unknown or other
  modified_base (363)..(363): a, c, t, g, unknown or other
  modified_base (386)..(386): a, c, t, g, unknown or other
  modified_base (411)..(411): a, c, t, g, unknown or other
  modified_base (442)..(442): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctgactcaggacacagggacctgggcccagtccgccctgactcagccagcctcgtgtctgggtctccgtggacagtcgctcaccctctcctgcatggaactatactgatgtagaaatataactgtctctgacagtactacccacgtaaacccccattccttactttanagtaagtacaataagccggcctggctntttcnctatcgtcttctcacggtctaccagtctggaccaacncgggtcctggttgaattacttcncggtccctcgtcgcctgacgaacgnggacctacgttattacgttcgctagtcctanagttagtacggtcggtactagtacgttacggttgggttccgttacgggcgggaacgggtcccggcgtacgaccgtttccgacggttccgaacggtcccaacggtcctccggtaacccccgtcgggttacctaccgtacgttccctccccgtaccctttcc

SEQ ID NO: 439249 - DNA, 796 bp, Homo sapiens
  misc_feature: GZ8MTXP02GRTNW.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcggctgagtcgttgggttttccttgtttgttattttacgaaggtgtccagagtgaagtgcgtaggttgggtgggaggtccgggggagtacgttggtccaggtccgtgggacggttccctggacgtacttcctccgtgtcgtccgtcctcgtaggtacttaccaccatcgagtacgacctacttagtagtcggacgttcgggtcccgccgacggccgtaccgggaagggggaacggggtcgtaggggtacggttcgggtccggttcggggaccccgtaacgtaaaaacggttaaaaaaacgtaaacggttaccgtacccgtaaggttactttttaccaccgaaacgtaacggtaccggtaacccggtcccggtacgttaccgtaggtaacgaaacgtaccgaagtacccttaccctacccctcgtaaacgaaaggtacgtaacgttacgtaaaccttaacgaaaactaaacgtttactaagtttacgtacgttccgtaggtaaaccgttaagtaaccgttaaacccgttaaacgtaaaaccggaaaacccgggtaaacggaaccggtaacgggtacttaagttagtttacgtttagtttggtttagttaaggtttattaagttactaacgtacggtacgttcggtaaccgg

SEQ ID NO: 439250 - DNA, 774 bp, Homo sapiens
  misc_feature: GZ8MTXP02FH7EI.44.36.D03.1.454.CMB.2.raw
  modified_base (204)..(204): a, c, t, g, unknown or other
  modified_base (219)..(219): a, c, t, g, unknown or other
  modified_base (271)..(271): a, c, t, g, unknown or other
  modified_base (314)..(314): a, c, t, g, unknown or other
  modified_base (401)..(401): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagctgggttttccttgttgttattttacaaggtgtccagagtgaagtgcaggttggnggaggtccggggganacgttggtccagccgtgggacgggtccctgagactctccgtgtgtcgcctgnggacttcaccatcagtcgaccactatatggactaggggtcccnccagggcctaccgaggggaaggggtctgggagtcgggcttggggaccgacaaaggtaaaaaaccgtaagttcgacctagtactttancaacaggtacgtaccgcccgtcgtactgtacgaaaacgccaagtacttcccaccctctacgaaagagatacgtaacttacgaaaacgtaaccttacgtaattacggtaactttaccacggtaacggtaaaattaccggaaaaccctttaaaacccggttaaaccggaaaaaacccgggacggggtaaaaccccggtaaacgggggaacccttaaacggtttaggttaaacgtttttaaacggtttgggttttacggttttaacggtttacggttttaaacttaaacggttaaccgtaaaacgggggttaaaacccttcgggtttacccccgaacggggtttacccgggggaacccggtttaaaaccccggggg

SEQ ID NO: 439251 - DNA, 694 bp, Homo sapiens
  misc_feature: GZ8MTXP02I7ESU.44.36.D03.1.454.CMB.2.raw
  modified_base (159)..(159): a, c, t, g, unknown or other
  modified_base (191)..(191): a, c, t, g, unknown or other
  modified_base (229)..(229): a, c, t, g, unknown or other
tcagacagtatatacacgaccggtgctcgatttagctgcgtcacgatctctcttggggggggtcacaagaggcagcgctctcgggacgtctccaccatggcctgggctctgctgctcctcactctcctcacccaggacacagggtcctgggcccagtcngccctgactcagcctgcctcgtgtctgggtcncctggacagtcggtcacctatcctcctgcacgtggacnccaggtacgttaatattcgttagttcttaactttgtactcctaggtactacaactattacactaccgaacggtaaacccaccccctaaatctaatacctatactaagtcggaacgtacccttaaagtaacggtaccggtacccttaccggtaggggtttacctaaccgttccgtccttacaccgtcctaccctaaccgtacgggtcccgtaccgaaacgtcccgcccttaccgtacgacctaacgtcctccggtcgcctaacgcggtctacgggaaggtacgacgggacttagtatttaccgttagttcgttgtacccttagaccgttaagttcgggttccacggtactacgttacgtaacttcggttacgtccggttaaaggtacgggtaacggtacctaaacgtccgtaacccgtattaacggggactaccgaacccgaacgacccctaaccctacgtaaccg

SEQ ID NO: 439252 - DNA, 638 bp, Homo sapiens
  misc_feature: GZ8MTXP02FZYKC.44.36.D03.1.454.CMB.2.raw
  modified_base (224)..(224): a, c, t, g, unknown or other
  modified_base (293)..(293): a, c, t, g, unknown or other
  modified_base (421)..(421): a, c, t, g, unknown or other
  modified_base (448)..(448): a, c, t, g, unknown or other
  modified_base (490)..(490): a, c, t, g, unknown or other
  modified_base (494)..(494): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggaggtccggggganacgttggtccagcctggaggtccctgagactctcctgtgtcgctctgattcacatcagtcgaccactanatggactggtcccgcgacggctccgaaggggaacggggcgtggggacgtgtcggtcggaccagtaaaacgtaaagtagttaccgactacgttattcactacgagtaccgaccgcgtacgtgagtaaanacccgtacagttcctacccgtccctanaaacgagctagacgtaactagaaactactgtatacgtttacnccgngtaaagtacttaacgtaaacctaaaccggtaaaacgaaacggtacaccggggacttaacgtagtttaacgtttaaacttggtttgtttagttaaggtttattaaacggttaccaagggtaaaccttcggtaccggttaacccgg

SEQ ID NO: 439253 - DNA, 740 bp, Homo sapiens
  misc_feature: GZ8MTXP02JSF96.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtcttgggttttccttgtttgttattttacaggtgtccagagtgaagtgcgtagttgggtgggacggtccgggggagtacgttggtccgagtccgtgggacgggtccctggagtacctcttccgtgtgtccgtcctcgtggtactcaccatcacggtacgaccactatagtcggacttcgggtcccgaccgaggccgtaccgggaaggggaacggggtctaggggtacggttggtccgttcggggacccgtaaccgtaaaacggtaaaaaacctaaaggttccgaccgtacgttacttttacgaccgaacgacggtacgtaccgcccggtcgttcgtaacggtagaaaaccgtcccgagttacttaccccgtacccttacacgaaagtacgtacgttacgtaaaccttacgaaaacgtacccttgtagtttagtactttacgacgtaacggttaaatccggtaaaccgtaaaccgaaacgaaaaccccgggaggtaacccgacggggtaactaggttacgtttaagtttacggttgtttagtaagtttacgtttaaagcttacggtagttaaccgtgtaaccccgg

SEQ ID NO: 439254 - DNA, 719 bp, Homo sapiens
  misc_feature: GZ8MTXP02FM6JA.44.36.D03.1.454.CMB.2.raw
  modified_base (384)..(384): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgccccgagggaacgcctggagtggcttgcactacattcttacacgaatacgaacgaaaaactcctaacagtaactatactctagaagatactaacgtttaaccactacctaccgaaacggtaaccaacccttaacgaaaacgggtcgtaggtttacggttactttagtactacgaacccaaactagtacgtacccnggaccggacaaccgacggtacactaattactacgttgtgaccggtaaggtaagtacgggaagggtaaaacaacggtatagtttacggtttacgttagtaaacgtttaacttaaacgtttctaaccgtattcggacggtaacggtccgttaagggggaactaaaccggcccgttacggaccctaccgttccacccgtacgacgtacccttaccggaaccgaaccgggtccctaccggttccgttccccgtccccggcggtacccgtcccttaccggacctaccggaacggtaacgcccctacggtacgggggacgccgtaacgccggtacccgggg

SEQ ID NO: 439255 - DNA, 730 bp, Homo sapiens
  misc_feature: GZ8MTXP02F5EV4.44.36.D03.1.454.CMB.2.raw
  modified_base (292)..(292): a, c, t, g, unknown or other
  modified_base (416)..(416): a, c, t, g, unknown or other
  modified_base (557)..(557): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgttgggttttccttgttgtttattttacaaggtgtcagagtgaagtgctaggttggtggaggtccgggggagacgttggtccaggccgtgggacgggtccctgacgctctcctgtcgtccgctctggtattcaccntcagtcgaccacgtatagtggacgtcgggtcccgcgaggctaccggaggggtaacggggtctgggagtagacgttcggccgtaccgaaaacgtaaaaacaaaggttcgacctaagttcttttanaaccactaggaaccgtaccggcccgtgggttacctagtaacgaaaacgccgtaagtactttacccaccccctagtaacaaagggtaatacgttacgtaaacctttacgaaaacgtactactagtttaccgtatttacccgngaacccgtaaattaccgggtaaaccttaaaacccgtaaacggaaaaaccccgggagggtaaaaccgaccgggtactaaagttttacggttaaaatttttccggttggtttaacgttttgggtttaatttttaacaccgttaggtaaaccgggtaactttcggtaaaccccggg

SEQ ID NO: 439256 - DNA, 638 bp, Homo sapiens
  misc_feature: GZ8MTXP02FZMBY.44.36.D03.1.454.CMB.2.raw
  modified_base (222)..(222): a, c, t, g, unknown or other
  modified_base (306)..(306): a, c, t, g, unknown or other
  modified_base (377)..(377): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacttggtccagcctggagggtccctgagctctcctgtgtcgcctctggattcaccatcagtgaccatatatggactgggtcccncaggctccgaggggaacgggctgggagtgcttcggaccgacaaagtaaaaacaagttgaccagtcctttancacgagacgtaccgccgacgtctaggtagaaacgcccgaagtaaccttccaaccccctcttaaccgaaagtagacgttacggaaactttacgaaaagtaaccttctaagtttaggaactttcgacgacgtaaatttccgggaaaaccttaaaccgtacgaaaaacccgggcggaaccgtacggtactaagttacgttaaagtttacgttggtttagtttaagttactttaacgtacgtacgtaacgtaccgttcgtacccg

SEQ ID NO: 439257 - DNA, 835 bp, Homo sapiens
  misc_feature: GZ8MTXP02GW2QX.44.36.D03.1.454.CMB.2.raw
  modified_base (223)..(223): a, c, t, g, unknown or other
  modified_base (266)..(266): a, c, t, g, unknown or other
  modified_base (273)..(273): a, c, t, g, unknown or other
  modified_base (313)..(313): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcgtggttttcctgttagttatttacaaggtgtccagagtgagtgctagttggtggaggtccggggganacgttggtccagtccgtgggacgggtcctgacgactctcctgntcgcctnggatcacatcagtcgacactatacgtggactgggtacccncgaggcctaccgggaagggggtaacggggcctaggggacggttggggaccgtttcggggaaccccgagtaaaaaccggttaaaaaaaccgtaacgtttacggacccctaaaggttcccttttacaccaaccggaaggtaaccgttacccgacccggcggtttcctaaggggttaacggaaaaaccggtccctaaaggttaacccttcccgtaaccccctagttaaccgaagggtaattaacggtacgttaaccgtttaacaaaacgttaccttagtaatttacggtaacttttacccggaggttaaacccgtaaaggttttaacaaaacccgggttttaaaaaccccgtaaacgggggaaaaaaaaccccttcggggggaaaacccggaaacccgggggttactttaaaagggttcttttaaaagttttaaccggtttgggggttttaaattttggtttaagggttttaaaacccttaggtaacccggttaaaggggtaaacctttccggtttaacccgggg

SEQ ID NO: 439258 - DNA, 693 bp, Homo sapiens
  misc_feature: GZ8MTXP02GAFTR.44.36.D03.1.454.CMB.2.raw
  modified_base (204)..(204): a, c, t, g, unknown or other
  modified_base (218)..(218): a, c, t, g, unknown or other
  modified_base (451)..(451): a, c, t, g, unknown or other
tcagacagtatatacacgaccggtgctcgatttagctgcgtcacgatctctcttgggggagagcggagcccccagccccagaattcccaggtgttttcatttggtgatcagcactgaacacagaggactcaccatggagttcgggctgagctgggttttccttgttgttatttacaaggtgtccagagtgaagtgcaggttggnggagtccggggganacttggtccaggcctggagggtccctgagactctcctgtgtcgctctggattcaccatcagtgaccactatagtggacgtgggtccgccaggcctaccgaggggaaggggctgggagtggcttgggccgacaaaggtaaaaaacgaagttcgacccgagtacctttagcaacgagaggtaccgcccggtcgtacctggtacgaaaagtcccaaagtacttacccaccccgtanaccgtaaaagaccgtatacggtaactttacgaaaaacgtacctactaaagttagaacttttacgacggaccgtaaaatttaccggaaaccttaaaaccgtaacggaaaaaaccccgtaggaaaccgaccgggataaacgttggttaaaatttgttgtttaacgtttgtaacgttttataaagtaaccgtaaggtaaacttcggtaaccccgtaaggttccgggggaaccgttaaacccgggg

SEQ ID NO: 439259 - DNA, 657 bp, Homo sapiens
  misc_feature: GZ8MTXP02GIPOV.44.36.D03.1.454.CMB.2.raw
  modified_base (295)..(295): a, c, t, g, unknown or other
  modified_base (485)..(485): a, c, t, g, unknown or other
  modified_base (492)..(492): a, c, t, g, unknown or other
  modified_base (505)..(505): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaggtgtcagagtgaagtgctaggttgggtggaggtccgggggagtacgttcggtccaggccgtgggacgggttccctggaacgtctctccgtgtgtcgcctcgtggattcacntcagtcgacctactatagtgacgtcggtcccgcgaggtcctaccggaggggaacggggcgtgggagtcggtcgttacggccgtaccgtaaaagtaaaaaaccgtaggttacgacccgtaagttactttacgcaacgtagacgtaccgcgtcgtcgtagtacgaaacgtcaagtacttcccacccgtctanaaagtanatacgtaacttanaaacgtaacttcaattcgtaactcgtacgacgtaaagtacgaaccttaaaccgaacggaaaaccgacgggaaacgcgggactacgttaagttactttaagttggttgttaagttagtttacgtacgtagtaacgtaacgtttcgtaacccgg

SEQ ID NO: 439260 - DNA, 765 bp, Homo sapiens
  misc_feature: GZ8MTXP02JUF1K.44.36.D03.1.454.CMB.2.raw
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgtttattttacaaggtgtccagagtgaagtgctaggttggtgggaggtccgggggagtacgttggtccaggtccgtgggacgggtccctgacgtactctccgtgtcgtccgcctcgtggacttccaccatcagtcgacctacttatagtcggacgtcgggtcccgccgacggccgtaccgggaaggggacggggtcgtaggggaggttcgggtccgttcgggacccgaacgtaaaacgtaaaaaacgtaacggttacgaccgaaggttaccttttacgaccgtaaacgacggtaacggtacccgcccggtcggttacgtagggtaacgaaaacgtcccgtaaaggttaccctttaccccgaacccctttaccgtaaccgaaaaggtacgtacgttacgtaaaccttaacgaaacgtacttacgtaagtttaggtacctttacgtacgtaacgtaaacgttaccgtaaacccgtaaaccgtaaaaccggaaaacccggtacgggaaccgtacgggactaagttagttaactttgtttagttggtttaagtttacgtttaagtacgtacggtaaacggttacgttcgtaacccgg

SEQ ID NO: 439261 - DNA, 809 bp, Homo sapiens
  misc_feature: GZ8MTXP02G5041.44.36.D03.1.454.CMB.2.raw
tcagacagtatatacacgaccggtgctcgatttagctgcgtcacgatctctcttgggagctctcagagaggtgccttagccctggattccaaggcatttccacttggtgatcagcactgaacacagaggactcaccatggagttggggctgcgcttggttttccttgttgcttatttagaaggtgtcactgtgaggtgcggctggtggagtcggtgggggagcgtttgggtacgacgggtcggggggggtcctggacgtacgttccttccgtggtcgaccgtcgccctacgttaggactttcgacttccttactagtacgtaacttagtcgtcctaagttcggtaaaccggtcggggtcccgacgacggacccgtaccgggtagggggaacggggtcgtaggggtagggtttggggtttacccctaagttagttaggtttaaacttaagttcgacgttacggggtaacgaacttaaccccgtaaccttaccgttaacgaccgtaacgtaaccttcggtacggtaacggaacgggtaccgttaacgtaccgtaaacccgtaaacgtttaccccggaagggtaaacctaacgttacggaaccctaaacgtaaccccggttataccgtttacgggtaattacccggtaaaggtaaccttaacggaaacgacgtaacccggttaagggaacggtaacgaaacccggggacggacgtaccgggtacgtttaaccggtacctttaacgtttcgttaacgggtttaaacccgaggtacggttaccggtacccggggttactaacgggttttccggg

SEQ ID NO: 439262 - DNA, 684 bp, Homo sapiens
  misc_feature: GZ8MTXP02GOUBM.44.36.D03.1.454.CMB.2.raw
  modified_base (209)..(209): a, c, t, g, unknown or other
  modified_base (223)..(223): a, c, t, g, unknown or other
  modified_base (265)..(265): a, c, t, g, unknown or other
  modified_base (288)..(288): a, c, t, g, unknown or other
  modified_base (492)..(492): a, c, t, g, unknown or other
  modified_base (648)..(648): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagagtactcaccatggagttcgggctgagctgggttttccttgttgttatttacaaggtgtccagagtgaagtgcaggttggnggagtccggggganacttggcagcctggagggtcctgagctctcctgtgtcgcctnggattcaccatcagtgaccatanatgactgggtcccgcaggctaccggaggggaacggggctaggggacggtggccgttaggggaccgaccgaaaaggtaaaaaaacaaacggttcggaacccgtaagttacctttttacgcaaaccgtaggtaacgtacccggcccgcgttacgtggtaaacgaaaagccccgaaggtacttacccacccttacaaccgaaaaggngtaaactcgaacctttaaccgaaaagtaaaccttcctaaagtttacgactttaccgaggacgtaaattacgaaccttaaaaccaaggaaaaaccccggtgggaaaaccccgagggaacctagtacggttaacttaacgtttggacgttttaagttntttaaagtactaacgaaggttaaccttcggaacccg

SEQ ID NO: 439263 - DNA, 631 bp, Homo sapiens
  misc_feature: GZ8MTXP02FP1F3.44.36.D03.1.454.CMB.2.raw
  modified_base (223)..(223): a, c, t, g, unknown or other
  modified_base (391)..(391): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggaggtccggggganacttggtccagcctggagggtccctgagactctcctgtgtcgcctcgtggattcaccatcagtcgaccactatatggactgggtccgccgaggcctccgaggggagggcgtgggagtggcgttcggccgaccgtaaagtaaaaaccgaaggttcaccgagtcctttanccaacgagacgtaccgtccgcgtacgtagtacgaaacgcccaagtacttcccacccctctacaaacgtagatcgtaacttacaaagtacctatagttagtacttacgtcgaacgaacttacggaaaccttaaaccgtaacgaaaaacccggtacggaaccgacggggtacaagttagttaacgtttagttagttagtttgttacgtttaatagtaccgtaaagtaccgttagtaccccgg

SEQ ID NO: 439264 - DNA, 673 bp, Homo sapiens
  misc_feature: GZ8MTXP02FH3D5.44.36.D03.1.454.CMB.2.raw
  modified_base (224)..(224): a, c, t, g, unknown or other
  modified_base (357)..(357): a, c, t, g, unknown or other
  modified_base (497)..(497): a, c, t, g, unknown or other
  modified_base (528)..(528): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggatttcgggctgagctgggttttccttgttgttattttacaaggtgtccagagtgaagtgcagttggtggaggtccggggganacgttggtccagccgtgggacgggtccctggacgactctccgtgtcgtcggcctctggattcacatcagtgacctactatatggacgtgggtccgccgtaggcctccggaaggggacgggctggggagtcggngttcggccggactaagtaaaaaacgagttcggacctaggtcttttagccaaacgagtaacggtaccgacccggtcgtcttacggtagaaaacggcccgtaaaggtactttccctacccccgtaccttaaccgaaaggtanaacgtaggtaaaccttacgaaataaccctanatttcggtaattccgttagaccgtaaagttcggaaacctaaacgtacgaaaacccggacgaaccggaggacctaagttacgttagtttaacgttggtttaagtgtttagtttaatacgtacgtacggtaactacggttaacccgg

SEQ ID NO: 439265 - DNA, 622 bp, Homo sapiens
  misc_feature: GZ8MTXP02JS51M.44.36.D03.1.454.CMB.2.raw
  modified_base (186)..(186): a, c, t, g, unknown or other
  modified_base (208)..(208): a, c, t, g, unknown or other
  modified_base (223)..(223): a, c, t, g, unknown or other
  modified_base (313)..(313): a, c, t, g, unknown or other
  modified_base (364)..(364): a, c, t, g, unknown or other
  modified_base (375)..(375): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtntccagagtgaagtgcagttggnggaggtccggggganacttggtccaggcctgggagggtccctgagactctctgtcgtcgcctactggattcaccgatccagtcgaccatatatggactgggtccnccaggctaccgaggggagggctggagtggctggcacaagtaaaaacaggtnccagtctttanacaacgagtacgtaccgcgtgtacgtagtacgaaacgcctaagtaccttacccgaccccttacgtaacgaaaggacgttagtacgtaacttaacgaaactactataagttacgtattcgtagacctaaagtacgaaccgtaaaccgtaaacgaaaaccggaacggaaccggaacggacgtacgtacgttaacgttagttagttagttaagttagtttaacgttacgtacgtacgtacgtacgtaccg

SEQ ID NO: 439266 - DNA, 758 bp, Homo sapiens
  misc_feature: GZ8MTXP02JF8WK.44.36.D03.1.454.CMB.2.raw
  modified_base (275)..(275): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagcttgggttttccttgttgttattttacaaggtgtccagagtgaagtgcaggttgggtggaggtccgggggagtacttggtccagccgtggagggtccctgagactctctgtgtccgcctntgacttcaccatcagtcgaccactatatggacgtcgggtcccgaccgaggcctccggaggggacggggcgtgggagtggcttgggccgacgaagtaaaaacagttacgacagtctttatcaacgagacgtaccgccgtcgtcgtagtagaaacgcccgaagtacttcccgacccctcgtaacgtaaagtagtacgtacgtaaaccttacgtaaaacggtaaccttacttaagttttacgtaacttttccgacggtaccgttaaacttacggtaaacccttaaaaacccggtaaacgggtaaaaaaccccggggtaacgggtaaaacccgggaaacccgggggtaaccttaaacggtttaacgggtttaaactttttaaaacgggttttggttttaaggggtttttgtttaaacggggttttttaaattaaccggttaagtaaaacccggggtttaaaacgttttcgtttaaaccccccggggg

SEQ ID NO: 439267 - DNA, 722 bp, Homo sapiens
  misc_feature: GZ8MTXP02IN4BL.44.36.D03.1.454.CMB.2.raw
  modified_base (267)..(267): a, c, t, g, unknown or other
  modified_base (325)..(325): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccagggaacggccctggagtggcttgcacacatcttctcgaatgaacgaaaatcctacagtacatctctgaagancagtttaaccatctaccaaggacacctaccaaaagcaggtgtcttagtatagaccaanagtcggaccctgacggacaccgaggacaacaattattactagtgacgtaacgggtaaatgaaaccgggaaaagaaacgtagacgttgtttactagttaattaagtaaagttcttaacctattccgtagggtaccgtacggttaggggaccgaaaacggggtacccgtaaccggtacccgtaacccgttccgttaccccgtacgaccggttaccctacccccgttaaaccgaaaccggggtaccccctaacgtttacccccggggttaccccctttcccccccggtacgggtcccccggttacccccgttccggtcccgttaacccccggacggggtaaccggacccctaacccggtccgggttaccgggggaccaaacccggtcggacccccggggg

SEQ ID NO: 439268 - DNA, 590 bp, Homo sapiens
  misc_feature: GZ8MTXP02IAACU.44.36.D03.1.454.CMB.2.raw
  modified_base (276)..(276): a, c, t, g, unknown or other
  modified_base (348)..(348): a, c, t, g, unknown or other
  modified_base (397)..(397): a, c, t, g, unknown or other
  modified_base (403)..(403): a, c, t, g, unknown or other
  modified_base (415)..(415): a, c, t, g, unknown or other
  modified_base (488)..(488): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatgggtgtgagctggatccgtcacgcccccgagggaacggccctggaggtggcttggcacacactcttctacgaatgaacgtaaaactcctacgagttacatctctgaagancagtttaacacttcaccaaggccaacctaccgaaaggctaggtggtactttagatcgaaccaatgtcgaccncgcgacaccaggcacatatactgtcgacgtaagtagtacgacgggaaanaaacgngacgttggtctntaagttataacgtacttacgattcgagggacgttggacgggactaaacggggccgtagtccaccgtctcgacnggtcctaccacggaacggcccagttccggtcccctttcccggcgccccgaccgttcgccctcggcgaacgtcccgcgttcggcggtcaacggtcgcccgggg

SEQ ID NO: 439269 - DNA, 571 bp, Homo sapiens
  misc_feature: GZ8MTXP02JXUAQ.44.36.D03.1.454.CMB.2.raw
  modified_base (222)..(222): a, c, t, g, unknown or other
  modified_base (308)..(308): a, c, t, g, unknown or other
  modified_base (418)..(418): a, c, t, g, unknown or other
  modified_base (429)..(429): a, c, t, g, unknown or other
  modified_base (438)..(438): a, c, t, g, unknown or other
  modified_base (469)..(469): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttcctgttgttattttacaaggtgtccagagtgaagtgcagttggtggagtccggggganacgttggccagcctggagggtccctgagactctcctgtgtcgcctctggacttcaccatcagtgaccactatatggactgggtccnccaggctccgaggggaagggctgggagtggctgggccgccaagtaaaaacaagttagccaaggtctttagccaaacagacgtaacgcccgagtctgtgaaaagcccaagnttacgaccctntaccaaganatgaccttacaaagacctcaatggtatttcngacgtaatacgaaaccctaacaaggaaaaccgacggaacgacgggactagtacgtacttagttgttgttaagttacgtttatatacgacgtaacgtacgtcg

SEQ ID NO: 439270 - DNA, 662 bp, Homo sapiens
  misc_feature: GZ8MTXP02HGCQE.44.36.D03.1.454.CMB.2.raw
  modified_base (311)..(311): a, c, t, g, unknown or other
  modified_base (389)..(389): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttattttacaaggtgtccagagtgaagtgcagttggtggagtccgggggagacttggtccagccgtggagggtccctgagactctcctgtgtcgcctctggattccaccatcagtcgaccactatatggactgggtccnccaggctccgaggggaaggggctggagtgggcgttgggaccaccgaaagtaaaaaaccaaaggttgaccagtctttancaacgagagtaccgacgtcgtctagtacgaaagcccaaggacttacccaccccttcgaccgaaagagtaagtcgtaaactttacaaaacggttaactcgtaattcgtaattttacacggtacgtaaaatacggaacccttaaaacgtaacggaaaaaccccggacggtaaaccggacggggtactaggtttacgtaaattttacggtttaggtttggtttaagtttaaggttttaataccttaggtaaccggtaaacctttgggtaaacccgg

SEQ ID NO: 439271 - DNA, 801 bp, Homo sapiens
  misc_feature: GZ8MTXP02ILGTZ.44.36.D03.1.454.CMB.2.raw
  modified_base (221)..(221): a, c, t, g, unknown or other
tcagacagtatatacacgaccggtgctcgatttagctgcgtcacgatctctcttgggggagagcggagccccagccccagaattcccaggtgttttcatttggtgatcagcactgaacacagaggactcaccatggagttcgggctgagtctgggttttccttgttgtttatttacaaggtgtcagtagtgaagtgctaggttggtgggaggtcggggganacgttggtccagccgtgggacgggtccctgacgtactctccgtgtcgtcgcctcgtggtacttcacatcagtacgacctactagtagtaggtcgtcgggtccgcgcggccgtccggaagggggacggggtcgtggggacggtgggtccgttcgggacccgtaaataaacggtaaaaaactaggttcccgacccgtagttcttttaacacgactaacggtaccggtacccggccgtacggttcctacgggttaaacggaaactacccgtaaacgtacctttaccccacccgtataacccgaaagtacgtactaacgttaacttaacaaaacgtacttaccgttaagttcgttaactttccgtagtaaccgtaaacgtaccggttaaaccctaaaaccggtaaacgggttaaaaccggaacggggttaacccggaacgggtaaccttaaaggttaacgtttaaagtttggtttttacgttagggtttttacgtaagtttttaccgttaagtcggtaaaacggttaccgtttccggggtaacccgttacgggggtaccggggtaacccggtttaaacccgggg

SEQ ID NO: 439272 - DNA, 658 bp, Homo sapiens
  misc_feature: GZ8MTXP02FOXAX.44.36.D03.1.454.CMB.2.raw
  modified_base (338)..(338): a, c, t, g, unknown or other
tcagacagtatatacacgaccggtgctcgatttagctgcgtcacgatctctcttgggtcttgtcccaggtcaccttgaaggagtctggtcctgtgctggtgaaacccacagagaccctcacgctgacctgcaccatctctgggttctctctcaacgatattagaatggggtgtgagctgggactccgtcacggccccccgaggggaacggccctggagtggcttgcacacatccttctacgaatagaaacgaaaactcctacaagtaacatctactagaagagactagtttaaccatctaccaagaccacctacgaaaggctaggtgttacttagtanacgaaccaacacgtcgacctgacggacaccgagacaagattactaactgtcgacggaacggttaagagggtaacgggaaaagaacgacgtacttggtttactagtaattagtaaacgttacctacagttccgtaagggtacgttacgggtagggaacgaaacgggtaccctacgggtacctaccggttcctacccgtgaaccgttacctacccgaacggtaaccgcccgtacgttcccggtccccgttaccccgcggtccccgtccctacggccccgtaccgaggaaccgtccacgtcgggacggacacgcggtacccgg

SEQ ID NO: 439273 - DNA, 675 bp, Homo sapiens
  misc_feature: GZ8MTXP02HFUGN.44.36.D03.1.454.CMB.2.raw
  modified_base (263)..(263): a, c, t, g, unknown or other
  modified_base (271)..(271): a, c, t, g, unknown or other
  modified_base (314)..(314): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagctgggttttccttgttgttatttacaaggtgtccagagtgaagtgctagttggtgggaggtccgggggatacgttgggtccagccgtggacgggtcctgagactctcngtgcgctntgattcacatcagtcgaccactatagtggacgttcgggtcccnccgaggcctaccggaggggaaggggtctgggagtggcttggccgacgaaagtaaaaacagttcgaccagtctttcacaactagacgtacgcccggtcgtcagtagaaacgcccgtaagacctttacccacccttacacaaagacgatcggtaaccttacgaaagtaccttagtatttacggactttacgacgtaacgtaaagttccggtaaaccgttaaaacccgtaacggggaaaaaaccccgtagggaaccccggaaccgggggtaacttaaggtttaactttaaacgttaacgtttcggtttagttttaaggttagttttaaacagttaccgtaaagggtaacgttcggtaaccccgg

SEQ ID NO: 439274 - DNA, 620 bp, Homo sapiens
  misc_feature: GZ8MTXP02H1JSC.44.36.D03.1.454.CMB.2.raw
  modified_base (213)..(213): a, c, t, g, unknown or other
  modified_base (265)..(265): a, c, t, g, unknown or other
  modified_base (269)..(269): a, c, t, g, unknown or other
  modified_base (279)..(279): a, c, t, g, unknown or other
  modified_base (291)..(291): a, c, t, g, unknown or other
  modified_base (304)..(304): a, c, t, g, unknown or other
  modified_base (351)..(351): a, c, t, g, unknown or other
  modified_base (369)..(369): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatggagttcgggctgagtctgggtttccttgttgttattttacaaggtgtccagagtgaagtgcaggttggtggngtccgggggagacttggtccagcctggacggtccctgagtctctctgtgtcnctcnggattcactncagtcgacatanatgacgtggtccncagctaccgagggagggctggagtgacgtggccacgaaacgtaaaanagttcacacgtactttancacgagtaagcccggcacgttactagtacaaaacggtccaaggtacccttccgaccccctagtcaaaagggtcaacttacggtaaccttaaggaaaactaccctatagtttagaacctttacgagaccgaaatttaacggactttaaaccggacgtaaaaacccggggcgacggacggtattaaacgtagtttacgttagtttggttgttaagttacgtttaatacgtacggtacgtaacgtcgtacccgg

SEQ ID NO: 439275 - DNA, 681 bp, Homo sapiens
  misc_feature: GZ8MTXP02JS9EE.44.36.D03.1.454.CMB.2.raw
  modified_base (432)..(432): a, c, t, g, unknown or other
  modified_base (497)..(497): a, c, t, g, unknown or other
tcagacagtatatacacgaccggtgctcgatttagctgcgtcacgatctctcttggggagctctgagagcggagccccagccccagaattcccaggtgttttcatttggtgatcagcactgaacacagaggactcaccatgggagttcgggctgagtcgtgggttttccttgttgttattttacgaaggtgtccagagtgaagtgctaggttggtggaggtccgggggatacgttggtccagtcccgtgggacgggtccctaggagtaccttcgtcctggtcgtccgtcctctggacttccacctatccgagttacgaaccctatactaagtcggacgttcgggccctccgaggccctccggaaggggtagggcgtgggacgttgggcttggaccgactaaagtaaaaacgtacgtgacctagttctttacnccgaaagtagtacgtacgcccgtcgtacctgtaacgaaacgccctagtacttcccgaccccttanaacgaagactagtacgtaaactaccgaaataccttactaagtttcgtattaccgagtaacgtaaactacggtaaacccttaacggtaaacggaaaaccggtagaaacgtacggacttagtaacgttagttagtttcgttaggttcgttaagtttaacgcgttacggtagttaacctcggtaccg

SEQ ID NO: 439276 - DNA, 524 bp, Homo sapiens
  misc_feature: GZ8MTXP02JN7MV.44.36.D03.1.454.CMB.2.raw
  modified_base (146)..(146): a, c, t, g, unknown or other
  modified_base (218)..(218): a, c, t, g, unknown or other
  modified_base (285)..(285): a, c, t, g, unknown or other
  modified_base (301)..(301): a, c, t, g, unknown or other
  modified_base (363)..(363): a, c, t, g, unknown or other
  modified_base (366)..(367): a, c, t, g, unknown or other
  modified_base (373)..(373): a, c, t, g, unknown or other
  modified_base (379)..(379): a, c, t, g, unknown or other
  modified_base (386)..(386): a, c, t, g, unknown or other
  modified_base (399)..(399): a, c, t, g, unknown or other
  modified_base (405)..(405): a, c, t, g, unknown or other
  modified_base (407)..(407): a, c, t, g, unknown or other
  modified_base (409)..(409): a, c, t, g, unknown or other
  modified_base (411)..(411): a, c, t, g, unknown or other
  modified_base (418)..(418): a, c, t, g, unknown or other
  modified_base (424)..(424): a, c, t, g, unknown or other
  modified_base (438)..(438): a, c, t, g, unknown or other
tcagacagtatatacacgaccggtgctcgatttagctgcgtcacgatctctcttggggggagagcggagccccagccccagaattcccagggtgttttcatttggtgatcagcactgaacacagaggactcaccatggattcgggntgagctgggttttccttgttgttattttacaaggtgtccagagtgaagtgcagttggtggagtccggggganacttggtccagcctggagggtccctgagactctcctgtatcgcctctggattcaacatcatgaccanatagtggactgggccncaggctcgagggaaggggtcagggagtggcttggccacaagtaaaaacagtgccagtcttancanngtcgcncgtatnacgaaancagtactcacctnagaaananananactacanaactanatatatatgagaanagaacaactaacgaaacgaacgacgacgacactatatatagtagtagtagttatataacgtagacgtactacacgtacggacgacg

SEQ ID NO: 439277 - DNA, 576 bp, Homo sapiens
  misc_feature: GZ8MTXP01DQVUK.9.20.B09.1.454.CMB.2.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaaggaagagtgtccactggtaccaacagaggccaggccggcccctgtggtggtcgtctatgataacagtcgacccggcccctcgtcgactcccctgacgcgcttctctggcctccccaaactctaggggaaccaccggacccaaccctgaacccatcagccgacggggccgaaaggccggggatggacggccgaatatactgccaggtgtgctatattacgtcgtaccccgtgtcgggcgggggaccaaggcgtcgaccgtccgtaacgggtcacggcccgaacggctccgcccccgtcggtccaccgttcttccgttccccgccctcctcacgacgtcttcgtaacg

SEQ ID NO: 439278 - DNA, 667 bp, Homo sapiens
  misc_feature: GZ8MTXP01EWT9D.9.20.B09.1.454.CMB.2.raw
  modified_base (217)..(217): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtggganaagacattgcaaaggaagagtgtccactggtaaccaacagaggccaggcccgggcccctggtggtggtcgtctatgataacagtcgacccggccctcgtcgactccctgacgcgtcttctctcggcctaccccaactcgtagggaaccaccggacccaaccctgaacccatcagccgaggggccgaaagggccggggatggacggccgactattacgtgccgagggtgtggactagtacttacgtaccgtaacccccggttggttacccgggggaccggggggaaccaaacggtccgtacggtaccccggttccggtacgggtccgaaccggaaccccgaaacgggcctcccggccccccgttcggggtcccacccgtttcccgttcccggtttcccccggtccccttccccgttaccgacgggttacccgttaacgttcccgtaaccgg

SEQ ID NO: 439279 - DNA, 594 bp, Homo sapiens
  misc_feature: GZ8MTXP01AN5Z0.9.20.B09.1.454.CMB.2.raw
  modified_base (205)..(205): a, c, t, g, unknown or other
  modified_base (288)..(288): a, c, t, g, unknown or other
  modified_base (356)..(356): a, c, t, g, unknown or other
  modified_base (444)..(444): a, c, t, g, unknown or other
  modified_base (565)..(565): a, c, t, g, unknown or other
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtgtcagtgacccaggagggacgccaccattaccngtgtggagaagacattgcaaaggaagagtgtccactggaccaacagaggccaggccggccctgtggtgtcgtctatgataacngtcgaccggccctgtcgactccctgagcgtcttctcgtggcctccccaaacgtcgtacggggaaaccnccgggacccaaccccgtgaacccatccgacgccgaggggtacccgaaaggccggggatggacggccgactattacgtcgccgaggtgnggcatagtactccgaccccgtcggttccgggacgggggaccgaacgcgtacgaccgtccgtacggtccacgcccgaacggccgtccgccccgtcggtccttaccgttccttccgttccccnccctcctccgacgacgtaacgttcgaacg

SEQ ID NO: 439280 - DNA, 724 bp, Homo sapiens
  misc_feature: GZ8MTXP01A1JRL.9.20.B09.1.454.CMB.2.raw
tcagtgatacgtctcacgaccggtgctcgatttagtgtagtgtgaagggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaagggaagagtgtccactggtaccaacagaggccagggccgggcccctggtggtggtcgtctatgaataacagtcgacccggccctcgtcgactcccgtgacgcgtcttctcgtggcctaccccgaacttcgtacggggaaccaccgggacccaccctggaacccatccgacggccgacgggggcccgaaagggcccgggggatcgggacgggaccggaacttagttaccgtggccgagggttcgtcgggccaagttacttacgtcccggtaacccccgggttgggttcccgggggaccggggggtaacccaagggtccgttacgggtaaccccggttccgtaacggggttcccaaacggggccccgtaaacgggttcccgttcccgggacccccccgtttccgggttaccccacccggttttcccttaccccggtttccccccctaaccccttccccgttaccgaacggttacccggtttaacttcccgtaaccgg

SEQ ID NO: 439281 - DNA, 555 bp, Homo sapiens
  misc_feature: GZ8MTXP01B0LEK.9.20.B09.1.454.CMB.2.raw
  modified_base (295)..(295): a, c, t, g, unknown or other
  modified_base (358)..(358): a, c, t, g, unknown or other
  modified_base (490)..(490): a, c, t, g, unknown or other
  modified_base (515)..(515): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggccctggtggtggtcgtctatgataacngtcgaccggccctcgtcgatcccctgacgcgcttctctggctaccccaactcgtaggggaacncggacccaccctgacccatcagcaggggccgaagccggggatggaggccgactattactgccgaggtgtggcatattactcctaccccgtggttcgggcgggggaccaacggcgtcgaccgtccgtaggtcncgcccaaggctcgccccgtcggtcnccgttcttcgttccccgccctcctcagcgtaacttcaacg

SEQ ID NO: 439282 - DNA, 720 bp, Homo sapiens
  misc_feature: GZ8MTXP01CH6TE.9.20.B09.1.454.CMB.2.raw
  modified_base (214)..(214): a, c, t, g, unknown or other
  modified_base (248)..(248): a, c, t, g, unknown or other
  modified_base (288)..(288): a, c, t, g, unknown or other
  modified_base (680)..(680): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctggtgtcagtcggcccaggagggacgccaccattactgtgtgganaagacattgcaaggagagtgtccactggtaccanagaggccaggccggccctggtggtgtcgtctatgataacngtcgacccggcctcgtcgactcccctggacgccgtctttctcgtacggccttaccccccgaactcggtcggggaaaccacccggggaaccccctaaccccgtcggaacccctaagtcccgaacgggacccgaaccggggggaccccgaaacgggtccccggggggaaagtcgggaaccgggtacccgtaacgttaacgttaccgtaccggaccgtagggtcggtacggtactaagtttaaccgttaccggtaccccggtaccccgggtttcgggtacccgggggaccggggtaaccacggtccgttaccgacccggtaccgtacggccgacggaacccgacgggttcccgtcccgccccgttcgtcccttccgttccgttcccgttcccccnccccttccgtccgtacggttaccgttaacgttccgtaacg

SEQ ID NO: 439283 - DNA, 737 bp, Homo sapiens
  misc_feature: GZ8MTXP01D482U.9.20.B09.1.454.CMB.2.raw
  modified_base (221)..(221): a, c, t, g, unknown or other
  modified_base (240)..(240): a, c, t, g, unknown or other
  modified_base (395)..(395): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgccaccctcggtgtcagtcggccccgaggagggaccggccaccattacctgtgtggganaagacattgacgaaggagngtgtccactggtaccaacgaggacggccacgggcccggccctggtggtcggtcgtctagtgataacgagtcgacccggccctcgtcgactcccgtgcgtcgtcttcgcgtcggcctccccaactcgtacggaccaccggccccaccctgacctanaccgagcgtacgggggccgaaacgggcccgggggatacgggacggaccgtaacgttagttaaccgtcggtaccggagggttcgtacgggactaagtttaactttccggtaccccgttaacccccggggttcggggtttaccccgggggaccggggggtaaccccgtaacgggtccgttaccggggtaccccggttcccggttaaccggtccgacccgggtaaccccgtaacgggttcccgttcccggcccccccgttcgggtaacccttcccgtttcccgttccccgttaaccccccggtcccttccccgtcgtacgttacccggtaattcccgtaaccggg

SEQ ID NO: 439284 - DNA, 733 bp, Homo sapiens
  misc_feature: GZ8MTXP01EM4S8.9.20.B09.1.454.CMB.2.raw
  modified_base (299)..(299): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggcccaggagggacggccaccattacctgtgtgggagaagacattgacaaagggaagagtgtccactggtaccaacagaggccagggcccgggccctggtggtggtcgtctatgataacngtcgacccggccctcgtcgatccccgtgagcgtctttctctcggcctccccaactcgtacggggaaccaccggacccaccctgacccatccacggccgaagggggcccgaaacgggcccgggggagtcgggacgggacccgtaacgttacgtttaaccgtcggcccgtaaggggttggtcgggtactaagttactttaacggttaccccgtaaccccccggggtttcggggtttccgggggacccgggggggtaacccgaaacggggtccgttacggtaccccgggttccgtaacgggttccgaacgggaaccccgtaaacgggttccgttcccggccccccgttacccggggttcccttacccgttcccgttcccggtttcccccggtccccgttcccttccgaccggttaccgttaacgttccgtaaccggg

SEQ ID NO: 439285 - DNA, 694 bp, Homo sapiens
  misc_feature: GZ8MTXP01ARWMQ.9.20.B09.1.454.CMB.2.raw
  modified_base (219)..(219): a, c, t, g, unknown or other
  modified_base (667)..(667): a, c, t, g, unknown or other
  modified_base (693)..(693): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctggtgtcagtcggccccaggacgggaccgccaccgattacctgtgtggganaagactattgacaagggaagtagtgtccactcgggtaaccaacgaggacggccgtacgggccccgggcccctggtacgggtggtcgtctatgaataacagtcggaccggcccctgtccgactcccgtgacgtccgtcttcctcgtacggcctaccccccgtaactcgtacgggggaaacccacccggggaccccaacccccgtggacccactaccgacgggaccgacgggggacccgggaacgggtacccgggggatacgggaaccgggaccgtaacgttacgtttacccggcggtaccggtagggtcggtacgactaagttacttaccggtcccggtacccggttgggtacccggggacggggacgacgcgtaccgccgtccgtacgccaccggaaccgacggccgtcccgccccgtaccggtccttccgttccttcccgttccccnccctccgcgtacgaccgtcgttccgng

SEQ ID NO: 439286 - DNA, 701 bp, Homo sapiens
  misc_feature: GZ8MTXP01C1NJX.9.20.B09.1.454.CMB.2.raw
  modified_base (367)..(367): a, c, t, g, unknown or other
  modified_base (658)..(658): a, c, t, g, unknown or other
  modified_base (680)..(680): a, c, t, g, unknown or other
  modified_base (693)..(693): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgccaccctcggtgtcaggtcggccccgagggagggaccggccacctattacctggtggtgggagaagacattgacgaaggaagagtgtccacgtaggtaaccaacgaggacggccgacgggccccggcccgtggtggtggtcgtctagtgataacgaggtcggaccccggtcccctcggtaccgactcccgtgacgccgtcttcncgtcggcctacccctaacgtcgtacgggaacccacccggaacccctacccgtcgacccagtccgacggaccggaacgggggacccggaaacggggcccggggtaagtacgggaccgggtacccgtaacgtttaacgttaccgtcgggtaccgtagggtgtacggtactaagttacgtttacggtaccccgtaccccggggttcgggttaccgggggaccgggggtaaccacggcgtacggtacccgtccgtacggtccgaccgcccgtaagcccgtccgccccgtcggtcnccgttcttccgtccccacctcncacgttaccgtcncgtaacgg

SEQ ID NO: 439287 - DNA, 608 bp, Homo sapiens
  misc_feature: GZ8MTXP01ENBXY.9.20.B09.1.454.CMB.2.raw
  modified_base (554)..(554): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgacaaggaagagtgtaccactggtaaccaacgagacggccagggccccgggccccgtggtggtcggtcgtctatgataacagtgacccggccctcgcgactcccctgacgcgtcttctctcggcctccccaactcgtacgggaacacccggcccaccctgaccatcgagcgagggccgaaggccggggatggacggccgactattacgcgacgaggtgtgctattattacgtcccgtaccccggttgggttccgggccgggggtaccaggtccgtacgtccgtccgtacgtccgaccgcccaacggcctccggcccccgtcggtacccnccgtttccgttccgttccccgccctccgtcgacgttaccgtaacttcgtaacgg

SEQ ID NO: 439288 - DNA, 718 bp, Homo sapiens
  misc_feature: GZ8MTXP01D4JI3.9.20.B09.1.454.CMB.2.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctggtgtcagtcggccccaggagggacgccaccattacctgtgtgggagaagacattgcaaggaagagtgtccactggtaccaacagaggccaggccgggcccctgtggtgtcgtctatgataacagtcgacccggcccctcggtcgactcccctgagccgtctttcctctggtcctaccccaaccgttcgtacggggaaaccacccgggaccccacccgttgacccacgtccgaagccggaacgggggacccgaaacgggcccgggggagtagggacgggaccggtacttaagtttaaccttcggaccgtagggtggtacgggctaagttaactttacggtacccgtaacccccggggtttcgggtttccgggggaccggggggaacccgaacggtaccgtacgggtaacccggttccgtaaccgggttccgaccggcccgtaaacgggttcccgtaccggttccccccgttcgggttcccttacccgttccttacccggttccccctacccttcccgtacctacggttaccgtaacttccgtaaccggg

SEQ ID NO: 439289 - DNA, 514 bp, Homo sapiens
  misc_feature: GZ8MTXP02JIBMR.9.20.B09.1.454.CMB.2.raw
  modified_base (354)..(354): a, c, t, g, unknown or other
  modified_base (391)..(391): a, c, t, g, unknown or other
  modified_base (403)..(403): a, c, t, g, unknown or other
  modified_base (419)..(419): a, c, t, g, unknown or other
  modified_base (466)..(466): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggcccaggagggacggccaccattacctgtgtgggagaagacattgcaaggaagagtgtccactggtaccaacagaggccaggcccgggcccctggtggtggtcgtctatgataacagtcgaccggccctcgtcgatccctgacgcgcttctctggctccccaactcgtggaacncggccaccctgacccatcagcagggccaagccgggangagcgatatacngcagtgtgcatattancacccgtgttcgggcggggacagctgacgtctagtcacgccaggccncgcccctcggtcacctctcgtcccgccctccgtcacgacgtactcacg

SEQ ID NO: 439290 - DNA, 544 bp, Homo sapiens
  misc_feature: GZ8MTXP02HRIJ7.9.20.B09.1.454.CMB.2.raw
  modified_base (499)..(499): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccatggtaccaacagaggccaggccggccctgtggtggtcgtctatgataacagtgaccggcctcgtcgatccctgagcgcttctctggctcccaactctgggaacacggcccacctgaccatcagcagggccaagccggggatggaggcgacgtatactgccaggtgtggcatatatcaccccgtgttcgggcgggggaccaaggctcgaccgtccgtaggtccacgcccgaaacgggcctcgcccccgtcggtacccncctccgtccgtccccgccctacctccgacgtaccgtactacgacg

SEQ ID NO: 439291 - DNA, 588 bp, Homo sapiens
  misc_feature: GZ8MTXP02IUNQ0.9.20.B09.1.454.CMB.2.raw
  modified_base (294)..(294): a, c, t, g, unknown or other
  modified_base (322)..(322): a, c, t, g, unknown or other
  modified_base (430)..(430): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccagggagggacggccaccattacctgtgtgggagaagacattgcaaggaagagtgtccactggtaccaacagaggccaggccggccctgtggtggtcgtctatgataacngtgaccggccctcgtcgatccctgagcncttctctggcctcccaactcgtaggggaaccacggcccaccctgaccatccgagccgaggggccgaaagggccggggatggacggcgactattactcgccgtaggtgnggactattattactacccgtacccccggttcgggttccggggaccggggggaaccaaggccgtcggaacccgtccgtaacgggtcacggaccaaggcctcgcccccgtcggtccacgtcctcgttccccaccctcctaccacgtaccgtactcgtacg

SEQ ID NO: 439292 - DNA, 559 bp, Homo sapiens
  misc_feature: GZ8MTXP02G4FKL.9.20.B09.1.454.CMB.2.raw
  modified_base (351)..(351): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggccctggtggtggtcgtctatgataacagtgaccggccctcgtcgatccctgacgcgcttctctggctccccaactctgggaacncggccaccctgaccatccagcaggggccgaaggccggggatggacggcgactattacgtgccgaggtgtggcagttattactccgtacccccggttggttccggggccgggggaccaaggcgtcggacccgtccgtaggtcacgcccaacggcctcgcccctcggtccactccttcgtccccacccctcctacacgaccgtactcacg

SEQ ID NO: 439293 - DNA, 739 bp, Homo sapiens
  misc_feature: GZ8MTXP02JCYOP.9.20.B09.1.454.CMB.2.raw
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggcccaggaggacggccacattacctgtgtgggagaagacattgacaagggaagagtgtccactggtaaccaacaggacggccagggcccgggcccctggtcggtggtcgtctatgataacagtcgacccggccctcgcgactccctgacgcgtcttctctggctccccaactcgtacgggaaccacggacccacccgtgaaccctatccgaacgccgaacgggggacccgaaagggcccgggggatacgggacgggcccgtaacttacgttacgtcggacccgtaagggttcggtacgggtacctaagttaacgtttaacgtaccccgtaacccccccggggtttgggtttaccccggggggaccgggggggtaaacccaaacggggtcccgtacgggtaaccccggttaccgttaacggggtacccgaacggacccccgtaaacggggccccgttcccggaccccccgttcgggtaccctaacccgtttccgttacccggtttaaccccctaaccccttccccgttacgaaccgtacccggttaactaccctaaccgg

SEQ ID NO: 439294 - DNA, 526 bp, Homo sapiens
  misc_feature: GZ8MTXP02HBXE5.9.20.B09.1.454.CMB.2.raw
  modified_base (350)..(350): a, c, t, g, unknown or other
  modified_base (389)..(389): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggcccctgtggtggtcgtctatgataacagtgaccggccctcgtcgatccctgagcgcttctctggctccccaactctgggaacncggccaccctgaccatcagcagggccgaaagccggggangaggcgactagttactgccaggtgtggcatattatcgtaccccgtgttcgggcgggggaccaagctgaccgtctagtcacacccgaggctcgccccctcggtccacctctcgtcccaccctcctcagactactcacg

SEQ ID NO: 439295 - DNA, 533 bp, Homo sapiens
  misc_feature: GZ8MTXP02FY62D.9.20.B09.1.454.CMB.2.raw
  modified_base (356)..(356): a, c, t, g, unknown or other
  modified_base (409)..(409): a, c, t, g, unknown or other
  modified_base (485)..(485): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctggtggtggtcgtctatgataacagtgaccggcctcgtcgatcccctgacgcgcttctctggcctccccaactctgggaaaccncggccacctgaccatcagcagggccgaagccggggatggaggccgatattacngccaggtgtggcatattatccaccccgtgtcggggcgggggaccaagctcgaccgtcaggtcacgcccgaaggccncgcccctcggtccactctcgtccccaccctcctcacgacgtactcacg

SEQ ID NO: 439296 - DNA, 536 bp, Homo sapiens
  misc_feature: GZ8MTXP02FIG3L.9.20.B09.1.454.CMB.2.raw
  modified_base (330)..(330): a, c, t, g, unknown or other
  modified_base (353)..(353): a, c, t, g, unknown or other
  modified_base (411)..(411): a, c, t, g, unknown or other
  modified_base (530)..(530): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggcccgggcccctgtggtggtcgtctatgataacagtgaccggccctcgtcgatcccctgagcgcttcnctggctccccaactctgggaacncggccaccctgacccatcagcaggggccaaaggcccggggatgaggccgactattacngccaggtgtggcatattaatccacccccgtgttcgggcgggggaccagctgaccgtctaggtcagcccaaggctcgccccctcggtccactctcgttcccgccctcctcacgacgtacnctaacg

SEQ ID NO: 439297 - DNA, 558 bp, Homo sapiens
  misc_feature: GZ8MTXP02IP79N.9.20.B09.1.454.CMB.2.raw
  modified_base (332)..(332): a, c, t, g, unknown or other
  modified_base (434)..(434): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccatggtaaccaacagaggccagggccggcccctggtggtggtcgtctatgataacagtgacccggccctcggtcgatcccctgagcgcttcnctggctccccaatcgtgggaaacaccggccaaccctgaacccatccagcgacggggaccgaagcccgggggatggacggccgactatactgccaggtgtggnagtatatccaccccgtgttacgggcgggggaccaagcgtacgaccgtctaggtcagacccgaggcctccgcccccgtcggtccacctcctcgttccccaccctcctacacgtacgtactctacg

SEQ ID NO: 439298 - DNA, 614 bp, Homo sapiens
  misc_feature: GZ8MTXP02GXUJP.9.20.B09.1.454.CMB.2.raw
  modified_base (296)..(296): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccggcccctggtggtggtcgtctatgataacgngtgaccggccctcgtcgatccctggagcgcttctctggtctcccccaactctacggggaacaccggcccaacccgtgacccatccgaagccgaacggggcccgaaaggcccgggggtatacggacgggccgaacgtagttactggaccagggtgtacggcaattattaactccgtacccccgttgggttccggggccgggggaacccgaacggccgtcggacccgttccgtaacggtccgacgacccgaaggcctccgcccccgtcggtccaccttccgtcgttcccccgaccctcctcgacgtaccgtactaccacg

SEQ ID NO: 439299 - DNA, 688 bp, Homo sapiens
  misc_feature: GZ8MTXP02G49IR.9.20.B09.1.454.CMB.2.raw
  modified_base (304)..(304): a, c, t, g, unknown or other
  modified_base (374)..(374): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggcccaggagggacggccacattacctgtgtgggagaagacattgacaaaggaagagtgtccatcggtaaccaacgaggacggccacggcccggcccctggtggtggtcgtctatgaataacgngtcgacccggccctcgtcgactcccgtgacgcgtcttcctcgtcggctaccccaactcgtacgggaaccnccggcccacctcgaccatccgacgaccgacggggacccggaaagggcccggggagtcggacggaccgaacttacgttacgcggaccgtaggggtgacgggactaagttactttacgtaccccgttacccccgggttgggttcccgggggaaccgggggtacctaacggccgtaccggtaccccggttccggttaacggtccgaaccggccccggaaacggtcccgtccccggtcccccgttaccgggtcctaccgtccgttcccggtaaccccgtcccctacccgtaccgtacgaccgttaccggtactaccgg

SEQ ID NO: 439300 - DNA, 698 bp, Homo sapiens
  misc_feature: GZ8MTXP02HRFHS.9.20.B09.1.454.CMB.2.raw
  modified_base (209)..(209): a, c, t, g, unknown or other
  modified_base (416)..(416): a, c, t, g, unknown or other
  modified_base (438)..(438): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtcggcccagggagggacggccaccattaccngtgtgggagaagacattgacaaaggaagagtcgtccacgttggtaaccaacgaggacggccacggggtccccggcccctgggtcggtcggttacgtcttagtggtaataaaccgaggttcggaaccccggtcccgtcggttccgacgtcccctggagcgtcctttctccgtggccttaccccgaaactccggttggggaaaaccccnccggacccctactcgacctacncgacggtccggacggggaccggaagggccggggtagacggacgtaccgtacttacgttacgcgtacgtgggtcgtcgacttagttacttaccgtcccggtacccggttcgggtaccgggggaccggggaccacggtcgtaccggtaccgtaccggtacgtaccgaccggtaccgacgtcccgtccgccccggttacgtccctcgttcccgttcccgttaacccctccgtacccgttacgaccgtaccgtacgtaccgacg

SEQ ID NO: 439301 - DNA, 697 bp, Homo sapiens
  misc_feature: GZ8MTXP02H32N5.9.20.B09.1.454.CMB.2.raw
  modified_base (227)..(227): a, c, t, g, unknown or other
  modified_base (332)..(332): a, c, t, g, unknown or other
  modified_base (414)..(414): a, c, t, g, unknown or other
  modified_base (678)..(678): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagcccaccctcggtgtcagtcggccccagggacggaccggccacctacttacctggtggtagggaanaagactattgacgaaggaagagtcgtccacgtcggtaaccaacgaggacggcccgacggggccccggtccccgtggtcgggtcggtccgtctagtgacttaacgnggttcgaccccggtcccttacgccgtacctccccgtgacgtcgtccttctcgtcgtcctacccaccgtcgtacggggaaccnccggaccccaccccgtgaaccctacgccgacgaccggacgggggtaccgaaacggggacccgggggtagtacggacgggtacccgaacgtttacgttaacgtcggacgtaggggtacgttggactaagttactttaccgtcccgttaccccggttgggtccgggggaccgggggtacacggtcgtacgacccgtcgttagccgtacgcccgacggtcctccgacccccgttcgcctaccttcgttcccgtcccctacccttacnccgacgtacgtactcgacg

SEQ ID NO: 439302 - DNA, 708 bp, Homo sapiens
  misc_feature: GZ8MTXP02I6A3Y.9.20.B09.1.454.CMB.2.raw
  modified_base (638)..(638): a, c, t, g, unknown or other
tcagtgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcacgcccacccgtcggtgtcaggtcggccccgagggacgggaccgccaacctacttaccgtggtggtagggaagaaagacagttgacgaaagggaagagtcgtaccaacgtggtaacccaacgaggacggccacgggccccggcctggtcggtggtcgtctagtagataacgaggtcgacccggtcctcggtacgtcttccccgtgacgtccgtctttccgtcgtcggtacctacccccgtaacttccgggtacggggaaaccctcccgggacccctacccgtcgaaccctacgtaccgaacggcccggaaacgggggtacccggaaacgggggtcccgggggaagtcgggaaccgggtacccgtaacgttacgttacgccgggacgtagggtccggtgactattacttaccgcccggtacccgtgggtaccggggacgggacaggcgtacgaccgtgacgcgaccgtccggacgtccnccggtaccccctgtacccgaccttccgttaccctcccccgtacctccgtacgacgtaccctagtcgacgg

SEQ ID NO: 439303 - DNA, 614 bp, Homo sapiens
  misc_feature: GZ8MTXP01EP6SN.11.10.A10.1.454.CMB.2.raw
  modified_base (431)..(431): a, c, t, g, unknown or other
  modified_base (605)..(605): a, c, t, g, unknown or other
  modified_base (607)..(607): a, c, t, g, unknown or other
  modified_base (609)..(610): a, c, t, g, unknown or other
  modified_base (612)..(612): a, c, t, g, unknown or other
  modified_base (614)..(614): a, c, t, g, unknown or other
tcagcgagagataccacgaccggtgctcgatttagcgtcgatctcagggcaggggtccgggagatcatgagggtgtcctcggctctcaggctgttcatttgcatatacatcatttttcttggaattgtctctggagatggtggtagcagatacttcgcagactccgtgaagggccggttcaccatctccagagacaattaccaagaaaatgatgtatatgacaaatgaacagcctgagagccgaggacacggccgtatattctgtgacgaaagagtcggcatatagtgcctacgaccgtgggattgatgtcttttgattagtcgtggggaccaagggacaagtggtacacccgttctcttcagccctacccgaaccgaacggggcccacgttccggtcccttccccgtcggccacccctcctccgaaacgngaccaccgtcggcggggcacgacggccgggggccccgttggggccttcggcccgttacgggtaccgtaaacggggtaaccctttaccgtttcccgggtaacttccccttcgtccggtccgttacgggcgggcgggggcccgttagggccgaaacgggcccggttaataagtcgngngnngngn

SEQ ID NO: 439304 - DNA, 556 bp, Homo sapiens
  misc_feature: GZ8MTXP01AJ703.11.10.A10.1.454.CMB.2.raw
  modified_base (551)..(556): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatgatgtatatgacaaatgaacagcctgagagccgaggacacggccgtatattctgtgcgaaagatcgggcatatagtgcctacgacctgggattgatgtcttttgatatcgtggggaccaagggacaatggtcaccgtctcttcacgccctccacccaacgggcccactccgggtccttcccccgtcggcacccctcctcccgaaagtcgcacccgttcgtcgggggaccacgacggcccgggggtccccgtgggggtcctcggacccgtgggtaccaagggtaccttaccgtttcccgtattccgtctcggcttgggacgcggggctgggcgagggcgcatgnnnnnn

SEQ ID NO: 439305 - DNA, 555 bp, Homo sapiens
  misc_feature: GZ8MTXP01DLJCI.11.10.A10.1.454.CMB.2.raw
  modified_base (550)..(555): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatagatgtatatgcaaatgaaacagcctgagagccgaggacacggccgtatattctgtgacgaaagatcgggcatatagtgcctacgaccgtgggggattgatgtcttttgattatctgggggaccaaaggggacaaatggtcaccgtctcttcgagccctaccacccaagggcccatccggtccttccccgtcggccctaccctcctacccaagacgcacccgtctcggggggaccacgacggccgggggccccgtgggggcctcggccctgggtacgaacggtacctacttcccgtaatcctctccgcttggacgcggggcctgggcgaacggcgcataagnnnnnn

SEQ ID NO: 439306 - DNA, 494 bp, Homo sapiens
  misc_feature: GZ8MTXP02HLJKF.11.10.A10.1.454.CMB.2.raw
  modified_base (413)..(413): a, c, t, g, unknown or other
  modified_base (479)..(479): a, c, t, g, unknown or other
  modified_base (487)..(487): a, c, t, g, unknown or other
  modified_base (489)..(494): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatgatgtatatgcaaatgaacagcctgagagccgaggacacggccgtatatttctgtgcgaaagatcgggcatatagtgcctacgacctggggattgatgtctttgatatctggggccaagggacaatggtcacgtctctcagcctccaccaacgggcccatccggtccttccccctcggcaccccctctcccaagagccacctcgngggggcacgagcggccctgggcctgcctggcaaggactacttccgatctctcgctgagccgggtcncgcaggcnannnnnn

SEQ ID NO: 439307 - DNA, 584 bp, Homo sapiens
  misc_feature: GZ8MTXP02G9076.11.10.A10.1.454.CMB.2.raw
  modified_base (578)..(578): a, c, t, g, unknown or other
  modified_base (581)..(583): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatgatgtatatgcaaatgaacagcctgagagccgaggacacggccgtatattctgtgcgaaagatcgggcatatagtgcctacgacctggggattgatgtcttttgatatcgtggggccaagggacaagtggtcacgtctcttcagcctccaccgaagggcccatccggtccttcccccgtcggcccacccctccctacccaaagacgcctaacccgtcgtcgggggaccacgacggccggtcccccgtggggcccttggacccgtcgggtaccgaaacgggtaccttaaccgtttcccggtaactttcccgtccgttccggcgtcggaccgggtccggggtcgtcgggaccgaacgggccgcgagtacgcngcnnng

SEQ ID NO: 439308 - DNA, 535 bp, Homo sapiens
  misc_feature: GZ8MTXP02GKEOH.11.10.A10.1.454.CMB.2.raw
  modified_base (134)..(134): a, c, t, g, unknown or other
  modified_base (332)..(332): a, c, t, g, unknown or other
  modified_base (507)..(507): a, c, t, g, unknown or other
  modified_base (530)..(535): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggngatggtggtagcagatacttcgcagactccgtgaagggccggttcaccatctccagagacaattccaagaaaatgatgtatatgcaaatgaacagcctgagagccgaggacacggccgtatattctgtgcgaaagatcgggcatatagtgcctacgcctggggattgatgcttttgattatcgtggggccaagggganaacgtgtcaccgtctcttccagccctccaccgaacgggcccatccggtccttcccccgtcggtcccacccctccctacccgaacgcgtcaccctcgtcgggggcacgacgccggcccgtcggacgtcgcctggtacaggtacctacttcgtactctctcgctcggagccgggtcncggacacggcgaaccgagtacgnnnnnn

SEQ ID NO: 439309 - DNA, 515 bp, Homo sapiens
  misc_feature: GZ8MTXP02FMYM5.11.10.A10.1.454.CMB.2.raw
  modified_base (383)..(383): a, c, t, g, unknown or other
  modified_base (509)..(515): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatgatgtatatgcaaatgaacagcctgagagccgagacacggccgtatattctgtgacgaaagatcgggcatatagtgcctacgaccgtgggattgatgcttttgatatcgtggggaccaagggacaatggtcaccgtctcttcagcctcaccgaggccatcgtcctccctcggccnccctctacccagacgcacctcgtagggggccacgacggccggcccctgggaccttcggcctcggtaccgaaggaccttacgttcccgtatctctcgctggcgcggggcctgggcaaggccgaagannnnnnn

SEQ ID NO: 439310 - DNA, 594 bp, Homo sapiens
  misc_feature: GZ8MTXP02HT2WR.11.10.A10.1.454.CMB.2.raw
  modified_base (264)..(264): a, c, t, g, unknown or other
  modified_base (274)..(274): a, c, t, g, unknown or other
  modified_base (279)..(279): a, c, t, g, unknown or other
  modified_base (357)..(357): a, c, t, g, unknown or other
  modified_base (588)..(588): a, c, t, g, unknown or other
  modified_base (591)..(591): a, c, t, g, unknown or other
  modified_base (593)..(594): a, c, t, g, unknown or other
tcagcgagagataccacgaccggtgctcgatttagcgtcgatctcagggcaggggtccgggagatcatgagggtgtcctcggctctcaggctgttcatttgcatatacatcatttttcttggaattgtctctggagatgatggtagcagatacttcgcagactccgtgaagggccggttcaccatctccagagacaattaccaaagaaaatgatgtatatgacaaatgaacagcctgagagccgaggacacggccgtatattcngtgcgaaagntcggnatatagtgcctacgaccgtggggattggatgtcttttgatatcgtggggaccccaagggacaagtcggtacacccgtntcttcgagccctacccaaccgaacgggccctacgtccgttcccttccccccgtggaccctaccccctcctacccgaaacgacgcccaacccgttcgcgggggaccacgacggcgggccccgttgggccgtcgaccgtggtacgaacggtacttaccgttccgttactcgttccgtcgtcgttcggacggccggggacgttcgggaccgaaacggcccggaacgacgtacgngcncnn

SEQ ID NO: 439311 - DNA, 604 bp, Homo sapiens
  misc_feature: GZ8MTXP02HIWWS.11.10.A10.1.454.CMB.2.raw
  modified_base (230)..(230): a, c, t, g, unknown or other
  modified_base (260)..(260): a, c, t, g, unknown or other
  modified_base (598)..(599): a, c, t, g, unknown or other
  modified_base (601)..(601): a, c, t, g, unknown or other
  modified_base (603)..(604): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccgttcaccatctccagagacaattaccaaagaaaatgatgtatatgacaaatgaacngcctgagagccgaggacacggctatattcngtgacgaagagtcgggactatagtagtcgcccgtacggaccgtggggtattggattgttacttttagattacgtcggtacggggaacaaacggggaccaagtcggtacctaccgtcttctccgacgtccctacccgaacgaccggccctacgttcccgtccccttccccgcggtaccctaccctaccctaccgaacgcgcctacccgtcgacggggccacgacgccggccgtcggctcggtccgtacggacgaacgtaccgttacgttccgtacttccgtcgtccggacgtcgggaccggcgggtaccgacggaccgtaacggcgaaccgtagacgcnncncnn

SEQ ID NO: 439312 - DNA, 559 bp, Homo sapiens
  misc_feature: GZ8MTXP02FGHVE.11.10.A10.1.454.CMB.2.raw
  modified_base (245)..(245): a, c, t, g, unknown or other
  modified_base (314)..(314): a, c, t, g, unknown or other
  modified_base (553)..(554): a, c, t, g, unknown or other
  modified_base (556)..(556): a, c, t, g, unknown or other
  modified_base (558)..(559): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaattgtctctggagatggtggtagcagatacttcgcagactccgtgaagggccggttcaccatctccagagacaattccaagaaaatgatgtatatgcaaatgaacagcctgagagcgaggacncggccgtatattctgtgacgaaagatcgggcatatagtgcctacgacctggggattgatgctttgatancgtggggaccaaagggacaagtggtcaccggtcttcgttcacgccctacacccgaagggccccatccggttccctccccgtggccacccctcctacccaagcgaccaccgtcgacgggggcaacgcgcggcccgtgggcttcggccgtcggtacaaacggtacttaccgtccgtagttcctccgttcgcgtacggacggccggggtaccgtacggacgaacggccgaacgtagacgacnncncnn

SEQ ID NO: 439313 - DNA, 596 bp, Homo sapiens
  misc_feature: GZ8MTXP02GDKT5.11.10.A10.1.454.CMB.2.raw
  modified_base (590)..(590): a, c, t, g, unknown or other
  modified_base (593)..(593): a, c, t, g, unknown or other
  modified_base (595)..(596): a, c, t, g, unknown or other
tcagcgagagataccacgaccggtgctcgatttagcgtcgatctcagggcaggggtccgggagatcatgagggtgtcctcggctctcaggctgttcatttgcatatacatcatttttcttggaattgtctctggagatggtggtagcagatacttcgcagactccgtgaagggccggttcaccatctccagagacaattccaaagaaaatgatgtatatgacaaatgaacagcctgagagcgaggacacggcctatatttctgtgacgaaagacgtcgggacaagtatagtcgcctacgaccgtaggggatttggatgtctttttgatatcgtggggaccaagggactagtggtcctacgtcttctcgacgcctaccaccgaagggcccacgttccggttcccttcccccgtcggcccaccctcccgtaccaacgacgccacccgttcgggcggggcacggaccgccggcccgtggggcttcggccgtacggtacgaacggtcccttacttcccggtattcccgtcctcggtcttcgggacggtccgggcgttcggggacaacgggggtcccaacggtaaacgtacgcgngcncnn

SEQ ID NO: 439314 - DNA, 616 bp, Homo sapiens
  misc_feature: GZ8MTXP02JDMPW.11.10.A10.1.454.CMB.2.raw
  modified_base (272)..(272): a, c, t, g, unknown or other
  modified_base (285)..(285): a, c, t, g, unknown or other
  modified_base (371)..(371): a, c, t, g, unknown or other
  modified_base (573)..(573): a, c, t, g, unknown or other
  modified_base (611)..(613): a, c, t, g, unknown or other
  modified_base (615)..(616): a, c, t, g, unknown or other
tcagcgagagataccacgaccggtgctcgatttagcgtcgatctcagggcaggggtccgggagatcatgagggtgtcctcggctctcaggctgttcatttgcatatacatcattttcttggaatttgtctctggagatggtggtagcagatacttcgcagactccgtgaagggccggttcaccatctccagagacaattccaaagaaaatgatgtatatgacaaatgaacagcctgagagccgaggacacggctatattctgtgacgaaagngtcggcatatagngccttacggcctaggggattgattgttcttttagactagtcgtcggggacaaggggtacaagtcggtactaccgttctcttcgacnccctaccaaaccgacggccctaagttcccccggtcccttcccccgtcggacctccccctaccctaccgaaacgccgtaccaacccgttcggccgggggaccaaaccgaccggcccgggtccccgttcggggccttccggggtacccttacgggtacccgaaacgggtaccttaccgtttccggtaacttcctcgtcgtcggnggcggcggcggtacggacgacggcgaacgtagtacgcnnncnn

SEQ ID NO: 439315 - DNA, 564 bp, Homo sapiens
  misc_feature: GZ8MTXP02IV9TM.11.10.A10.1.454.CMB.2.raw
  modified_base (425)..(425): a, c, t, g, unknown or other
  modified_base (559)..(564): a, c, t, g, unknown or other
tcagcgagagataccacgaccggtgctcgatttagcgtcgatctcagggcagggggtccgggagatcatgagggtgtcctcggctctcaggctgttcatttgcatatacatctattttcttggaattgtctctggagatggtggtagcagatacttcgcagactccgtggaagggccggttcaccatctccagagacaattccaaagaaaatgatgtatatgacaaatgaacagcctgagagccggaggacacggccgtatattctgtgacgaagatcgggcatatagcgtcctacgaccgtggggattgatgtcttttgatatcgtggggaccaaggggacaagtggtcaccgtctcgttcacgcctcccaccgaagggccctagtccggtacccttcccctcggccacccctcctacccgaancgaccacccgtcgtacgggggccaacgcggccggccccgtggggcctcggtacctggttaccgaaaggtacctaacgtttcccgtacttctccgtcgacgtgacggcgggccgtgggaccacgggcgcaagtgnnnnnn

SEQ ID NO: 439316 - DNA, 543 bp, Homo sapiens
  misc_feature: GZ8MTXP01EUX6I.52.67.G01.1.454.CMB.2.raw
  modified_base (258)..(258): a, c, t, g, unknown or other
  modified_base (381)..(381): a, c, t, g, unknown or other
  modified_base (534)..(534): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatcctcctgcaggtctagtcaaggtccttcgtttcagtgatggaaacnctacttgaattggttcacagaggccaggccaacctccaaggcgacctaattataaggtttcaagcgggactcgtggggtcccagacagacttcagcggcaggtgggtcaaggcactgatttcncactgcaaatcgaggcggggtgaggtcgtgaggagttggttcggggttatacgtggcagttgacaaggtacaacgcgtcggcctcgtacgttcgaccgaagggaaccaaggttggaaacttcgaaacgattggttggactggcaactatcttntcttcgaac

SEQ ID NO: 439317 - DNA, 529 bp, Homo sapiens
  misc_feature: GZ8MTXP01D7BPC.52.67.G01.1.454.CMB.2.raw
  modified_base (254)..(254): a, c, t, g, unknown or other
  modified_base (285)..(285): a, c, t, g, unknown or other
  modified_base (346)..(346): a, c, t, g, unknown or other
  modified_base (362)..(362): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctgtttcagtgatggaaacnctatgaatgttcacagagcagcaactcagcnctaatttataagttctaagcgggactcgtgggtccagacagacttcagcggcagtgggtcngggcaacgtgatttcncactgacaaatcgaggtcggggtggaggctggaggtagttggttggggttattacgtgcatgacaaggtacacacgtggcctccggacgttcggaccgaagggaacaagggttaggaaattacgaaacgaacgttaggttggctgcaaccatcgttgtcttcgtaac

SEQ ID NO: 439318 - DNA, 627 bp, Homo sapiens
  misc_feature: GZ8MTXP01AVXIE.52.67.G01.1.454.CMB.2.raw
  modified_base (252)..(252): a, c, t, g, unknown or other
  modified_base (381)..(381): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccttggacagccgcctccatctcctgcaggtctagtcaaggcctcgtttcagtgatggaacnctacttgaattggttcaccagacggccaggccaacctcgaaggcaccttaatttataaggtttcaaggcgggtactcgtcggggtcccagacagacttcgagcggcaggtgggcaaggcactgatttcnactgacaaatcgagggcgggggtagaggtcgtaggtaggtagtttgggttaggggtttaattacgttggacctagttcggaacgtaaagggttccaaccgtacgttgggacccccgttacggtaccgggtttccggaacccgaaaggggaaccccgtaaaagggttacgggaaacttaccgaaaaggtaccttagggttcgggcttaaggaccaacccgtattccttaggttcccttcgtaacccg

SEQ ID NO: 439319 - DNA, 599 bp, Homo sapiens
  misc_feature: GZ8MTXP01DPAQX.52.67.G01.1.454.CMB.2.raw
  modified_base (257)..(257): a, c, t, g, unknown or other
  modified_base (379)..(379): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggctccatctcctgcaggtctagtcaaggtccttcgttttcagtgatggaaacnctactgaattggttcaccagaggccaggccaacctccaagcgacctaatttataaggtttcaagcggactcgtgggtcccagacagactcagcggcaggtgggtcaaggcaactgactttcncactgacaaatcgaggcggggtgagctagaggtatggttgggttattacgtgcgtagttgacgaagggtacacgacgttcggcccttccggtacgttccgggacccgaaaggggtaacccaaaggggttacgggaaaacttacgaaaacgggtaacttgggttcgggaccttaacgggacctaacccgtaattccgttaggttccctttaacgttaaccg

SEQ ID NO: 439320 - DNA, 528 bp, Homo sapiens
  misc_feature: GZ8MTXP01ALAG1.52.67.G01.1.454.CMB.2.raw
  modified_base (366)..(366): a, c, t, g, unknown or other
  modified_base (379)..(379): a, c, t, g, unknown or other
  modified_base (503)..(503): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacactacttgaattggttcaccagaggccaggccaacctccaaggcgcctaatttataaggtttctaagcgggactcgtggggtcccagacagacttcagcggcagtgggtcnggcactgatttcncactgacaaatcgaggcggggtgagctgaggatggttgggttatacgtgcatgcaaggtcacactggccctcggtcgttcggaccgaagggaaccaaggttgggaaacttcgaaacgacttggngctgcaaccatcttgtctttcaacc

SEQ ID NO: 439321 - DNA, 578 bp, Homo sapiens
  misc_feature: GZ8MTXP01EA4LA.52.67.G01.1.454.CMB.2.raw
  modified_base (257)..(257): a, c, t, g, unknown or other
  modified_base (366)..(366): a, c, t, g, unknown or other
  modified_base (379)..(379): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtcctcgttttcagtgatggaaacncctacttgaattggttcaccagaggccaggccaacctcaaggcgcctaatttataaggtttctaagcgggactcgtggggtcccagacagacttcagcgcagtgggtcnggcactgatttcncactgacaaatcgaggcggggtggaggcgtggaggtagttggttggggtttaattacgtggctaagttggactaagggtacacgacgttcggccctccggtacgttcggaccgaaaggggaaccgtaagggttaggaaacttacgaaaacggtaacgttaggttcgggactggacaacctatcttcgttcttctaaccg

SEQ ID NO: 439322 - DNA, 576 bp, Homo sapiens
  misc_feature: GZ8MTXP01ETCSO.52.67.G01.1.454.CMB.2.raw
  modified_base (254)..(254): a, c, t, g, unknown or other
  modified_base (410)..(410): a, c, t, g, unknown or other
  modified_base (547)..(547): a, c, t, g, unknown or other
  modified_base (557)..(557): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccttggacagccgcctccatctcctgcaggtctagtcaaggccttcgtttcagtgatggaaacnctactgaattggttcaccagacggccaggccaacctcgaaggctactaatttataaggtttcaaggcgggactcgaggggtcccagacagacttcagtcggcaggtgggtcaaggcactgtactttctacactgacaaatcgaggcggggtgaggngtggagtagttggttggggtttatacgtgcgattggacaagggtacacgtacgtcgggacctccggtaggttccggaccgaaacgggaaccgaaagggttacggaaattaccgaaacggtaacttggttcgggaccncgactaactntacgttcgttcttcgtaac

SEQ ID NO: 439323 - DNA, 570 bp, Homo sapiens
  misc_feature: GZ8MTXP01CX3JZ.52.67.G01.1.454.CMB.2.raw
  modified_base (279)..(279): a, c, t, g, unknown or other
  modified_base (383)..(383): a, c, t, g, unknown or other
  modified_base (411)..(411): a, c, t, g, unknown or other
  modified_base (420)..(420): a, c, t, g, unknown or other
  modified_base (457)..(457): a, c, t, g, unknown or other
  modified_base (507)..(507): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccgctccatctcctgcaggtctagtcaaggtccttcgttttcagtgataggaaacacctacttgaattggttcacagngccaggcaacctcaggcacctaatttataagtttcaaggcgggtactcgtcggggtcccagacagacttcagcggacaggtgggtcaaggctactgtactttcncactgacaaagtcgaggcggggtgaggntaggaggtnttggttgggttattacgtggctagtcgacaaggtacncgtacgtggaccctccgtacggttcggaccgtaaaggggaaccaaagggnggtaaaacttcgaaaacgtacgttgggttcgcgtgacctaacacttcttggtccttcgtaacc

SEQ ID NO: 439324 - DNA, 590 bp, Homo sapiens
  misc_feature: GZ8MTXP01CIM7I.52.67.G01.1.454.CMB.2.raw
  modified_base (364)..(364): a, c, t, g, unknown or other
  modified_base (380)..(380): a, c, t, g, unknown or other
  modified_base (392)..(392): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctccctggacacgccggcctccatctctgcaggtctagtcaaggtccttcgttttcagtgataggaaactaccttacttgaattggtcaccagacggccaggcccaacctccaaggccgtacctaatttagtaaggtttcaagcgggtactcgtcggggtcccagacagatcacgcggnaggtggtacaagggcncgtgtactttcncactgacaaatcgaggcggggtgagctaggaggtagttgggttaggggtttatacgtggactagttcggacgtaaagggtaccacgacgtcggccctacggtacggttcggaaccgtaaaggggaccaagggtaacggaaacttacgaaacgacgtggtcgcgttgaccaacctatctgtcttctaacgttccgtccc

SEQ ID NO: 439325 - DNA, 634 bp, Homo sapiens
  misc_feature: GZ8MTXP01E26CB.52.67.G01.1.454.CMB.2.raw
  modified_base (377)..(377): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgttttcagtgatacggaaacactacttgaattggttcaccagacggccaggccaaccgtcaacggcgtaccttaatttataaggtttcaagcgggactcgtggggtcccagacagtacttcgagcgcaggtcgggtacngggcaactgtactttcgtcactcgacaaagtcgaaggggtcgggggtaggaggtcgtaggtaagggtagtttagggtttgggggtttaatttaccgtggaccttaaggttacggacgtaaaggtaccgaaccgtacgttacggccccgttaccgtacgggtttccggaccggaaacgggaaccgaaagggttacgggaaacttacgaaacgtaacgttggttggcgtgactaacgactccttgtaacgttctaaccg

SEQ ID NO: 439326 - DNA, 610 bp, Homo sapiens
  misc_feature: GZ8MTXP01B61DC.52.67.G01.1.454.CMB.2.raw
  modified_base (376)..(376): a, c, t, g, unknown or other
  modified_base (462)..(462): a, c, t, g, unknown or other
  modified_base (585)..(585): a, c, t, g, unknown or other
  modified_base (593)..(593): a, c, t, g, unknown or other
  modified_base (604)..(604): a, c, t, g, unknown or other
tcagcgcagtacgacacgaccggtgctcgatttagagtatacatattgggtttggggactgatcaggactcctcagttcaccttctcacaatgaggctccctgctcagctccgtggggctgctaatgctctgggtcccagcatccacgtggggatgttataatgactcagtctccactctcctgcccgtctcctggacacgccgcctccatctcctgcaggtctagtcaaggtccttcgtttcagtgataggaaactactattagaattggttacaccgagacggccacggccaacctcaaggccacttaatttagtaaggtttcaaggcggacttcgcgggtccaagacagtactcgaggcggcaggtgggtacnggctaacgttgtactttctacagtagacaaatcggagggcggggtaggagcgtaggagggttagttggggtttagggttacttagngggactaagttggaacctaaagggtaccacgtaccgtcgggtacccctcgggtaaccggtccggaccggaaacgggtaagaacgggttaaggaaacttacgaaagtacttgggcgactgaccnctacgttnttacgtccttnaacccg

SEQ ID NO: 439327 - DNA, 583 bp, Homo sapiens
  misc_feature: GZ8MTXP01CDMPW.52.67.G01.1.454.CMB.2.raw
  modified_base (198)..(198): a, c, t, g, unknown or other
  modified_base (252)..(252): a, c, t, g, unknown or other
  modified_base (269)..(269): a, c, t, g, unknown or other
  modified_base (283)..(283): a, c, t, g, unknown or other
  modified_base (295)..(295): a, c, t, g, unknown or other
  modified_base (335)..(335): a, c, t, g, unknown or other
  modified_base (380)..(380): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcctggacncgccgctccatctcctgcagtctagtcaaggtccttgtttcagtgatggaaacnctatgattgttcacagngcagccactcagcnctattatagttnagcggactcgtggtccagacagactcagcgcaggtggtcnggcacgtgactttcgcatgacaatcgaggcgggtgagctgaggtnttgggttgggtttaatcgtgcgtagttgaccgtaaaggtaccacgtacgtcggaccctccggtaacggttccggaccgtaaaacggggaaccgtaaaggggttacggtaaaaacttaccgaaaaaaccggtcgttagggttcggaccgttggaaccctaacccgttaagttacccgttggttaacctttaaccgttaaccccg

SEQ ID NO: 439328 - DNA, 601 bp, Homo sapiens
  misc_feature: GZ8MTXP01BZX6A.52.67.G01.1.454.CMB.2.raw
  modified_base (401)..(401): a, c, t, g, unknown or other
  modified_base (486)..(486): a, c, t, g, unknown or other
  modified_base (586)..(586): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccctggacagccggcctccatctcctgcaggtctagtcaaggtccttcgtttcagttgatacggaaactacctacttgaattggttccaccgagacggccacggacccaaccgtccgaaggcctaccttaatttaacgtaaggtttcgaaaggccgggtaactcggtcggggtacccagaccaggtacttcgaggcggcaggtcgggtacngggctaacgtgtaactttccaccgatcgactaaagtcggagggcggggtaggaggtctggaggtagttggttagggttaattcgngacgagttggacgaaggtcacgtagcggtcctcgtacggttcgaccgaaggggcaaagggttgaaacttcgaaacggtattgggttgactgacaaccttntcttcgtcttcgtcg

SEQ ID NO: 439329 - DNA, 562 bp, Homo sapiens
  misc_feature: GZ8MTXP01APAT2.52.67.G01.1.454.CMB.2.raw
  modified_base (256)..(256): a, c, t, g, unknown or other
  modified_base (292)..(292): a, c, t, g, unknown or other
  modified_base (344)..(344): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccgctccatctcctgcaggtctagtcaaggtccttcgtttcagttgatggaaacnctactgaattggttcacagagcaggccaactcagcnctaattataggttcaagcggactcgtggggtcccaggacagacttcaggcgnaggtgggtcaaggcacgtgtactttcacatcgacaaatcgaggcggggtgaggctggaggtagttggttaggggtttattacgtgactagttggactaaggtaccaacgcgtcgccgtacgtacgttcggaccgtaagggaaccaaggttaggaaacttacgaaaaccgtacgttggttcggctcggcctaaccgtatcgttcttccgttcgtaaccg

SEQ ID NO: 439330 - DNA, 596 bp, Homo sapiens
  misc_feature: GZ8MTXP01EQ3EL.52.67.G01.1.454.CMB.2.raw
  modified_base (366)..(366): a, c, t, g, unknown or other
  modified_base (427)..(427): a, c, t, g, unknown or other
  modified_base (469)..(469): a, c, t, g, unknown or other
  modified_base (564)..(564): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccttggacagccgcctccatctcctgcaggtctagtcaaggtccttcgttttcagtgataggaaactacctattgaattggttcaccagagccacggccaacctccgaaggcaccttaatttataaggtttctaaggcgggtactcgtcggggtcccagacagtacttcgagcggnaggtgggctaagggcacgtgtatttccgtacacgtgaccaaagtcgagggcgggggtaggnggtacgtagggtaggtagttgggttggggtttaattacgtgngtagtgacgtaaggtacacgacgtcggaccgtccgtacggttccgaccggaacgggaaccgtaagggttagaaacttaacgaaacgtaacgttgngctgacaacctatcgttcgtcttcgtaacccg

SEQ ID NO: 439331 - DNA, 651 bp, Homo sapiens
  misc_feature: GZ8MTXP01B94CC.52.67.G01.1.454.CMB.2.raw
  modified_base (201)..(201): a, c, t, g, unknown or other
  modified_base (631)..(631): a, c, t, g, unknown or other
  modified_base (637)..(637): a, c, t, g, unknown or other
  modified_base (645)..(645): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccacgtggggatgttataatgactcagtcctccactctccctgcccgtctccctggacncgccgcctcatctcctgcaggtctagtcaggtccttgtttcagtgatcggaaactctatgaattggttcacagacgccacggaccaacctcgaaggcctaccttaaatttacgttaaggttcgtaaggacgggtactcgtcggggtacccagacagtacttcgagcggacgaggtcgggtacaagggctaccgttggtactttctacacgttagactaaagtccggagggcgggggttcggaagggtccgtgggtaccggggttatttcgggggtttaggggtttaacttacgtgacgttagtcgggtaacgaaacggttaccacgtacgtcgggaccccttccggtaccggttacggacccgtaaagggggaacccgaaggttagggaaaaccttcggaaaacgtacgttggttcggactcgactaacntcgttntccgtttnaacccg

SEQ ID NO: 439332 - DNA, 666 bp, Homo sapiens
  misc_feature: GZ8MTXP01DK8KR.52.67.G01.1.454.CMB.2.raw
  modified_base (289)..(289): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtcctccacttctccctgcccgtcttccgttggacacgcccgcctccatctcctgctaggtctagtcaacgtccttgtttcagtagataggaaactacctaacttgaattggttcaccgagnggccaggccaactcaaggctaccttaatttagtaaggtttctaaggcggtactcgtacgggggtaccccagaccgagtacttcgacggcgggtacagggttcggggtacaagggtacctacgttagtactttcgtacacgttagactaaagtcggaaggggtcggggtaggaggtcgtaggtagggtagtttgggttaggggtttattagtgtacgtaagtcgtaacgtaacgggtacctacgtacggtcggtaccccttcggtaaccggttaccggaccggtaaacgggaaccgtaaagggttaacggaaacttacggaaaacgtcgttggcgttacgtcgacctaaccgtatccgttagttaaccttcttaaccg

SEQ ID NO: 439333 - DNA, 611 bp, Homo sapiens
  misc_feature: GZ8MTXP01A184E.52.67.G01.1.454.CMB.2.raw
  modified_base (388)..(388): a, c, t, g, unknown or other
  modified_base (590)..(590): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccctggacacgccgcctccatctcctgcaggtctagtcaaggtccttcgttttcagtgatacggaaactactacttgaattggttacaccgagacggccacggcccaacctccgaaggccgtaccttaaatttagtaaggtttctaaggcgggtactcggtcgggtcccagacagtacttcgagcggcaggtgggtcnggtcacgtgtactttcacactgacaaacgtcgagggcggggtgaggcgtagggagtgttggttagggtttatcgtgctagtacgacgtaaggtacacgtacgtccggacccttcccggtaacgggttccggacgtaacggggaacgaaggttacggaaacttacggaaacgtacgttgggttcggcgtaacgcctaaccgtntcgttagttccgttcgtcccg

SEQ ID NO: 439334 - DNA, 710 bp, Homo sapiens
  misc_feature: GZ8MTXP01EFP0N.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccacgtggggatgttataatgactcagtcctccactctccctgcccgtctccctggacacgccgcctccatctcctgcaggtctagtcaaggtccttcgtttcagtgagtacggaaacctctaacttgaattcggttaccacgagacggccctaggaccccaacctaccgaacggcctaacctttaatttacgtaaacggttttcgaaaggccgggtactcggtcggggtacccagacagtacttccgaggcggactaggttgggacaagggtcctacgttagtacttttccacgtacgttagacctaaagtccggtacgggacgggggttaggagggtaccgttagggtaagggtaggtttagggtttaggggtttaacttagtacgtaccggtagtacggtaacgtaacggttaacaccgtaccgtcggtacccgtccggtaccgggttaccggaaccggtaacgggtaaccgtaaggaacggtaaacgttaccgaaaacgtacgttagggttcgaccgtaacggccctaaccggtattaccgttacgttcccttaacgttccccg

SEQ ID NO: 439335 - DNA, 671 bp, Homo sapiens
  misc_feature: GZ8MTXP01ETYVS.52.67.G01.1.454.CMB.2.raw
  modified_base (199)..(199): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccatggggatgttataatgactcagtctccactctccctgcccgtctcccttggacncgcccggcctccatcctcctgctaggtctagtcaaggtccttcgtttcagtgatacggaaactctattgaattcggttcaccgagacggaccacggaccaacctaccgaaggtaccgtaccttaaatttagtaaacggtttcgtaaggcgggtacttacggtcggggtacccaagacaggtaacttcggagtcggacgagggttcgggcaaggggtcctacgttggtaaccttttcacacgttagactaaagtccggaaggggtcggggtgggaaggtcgtaggagggtgttacgggttgggtttaatcgtggactagttgaccgaaagggtaccacgtaccgtcggacccgttccggtaacgggttccggaaccgaaggggaacctaaggggttaacggaaacttaccggaaaacgtacgttggttcggacccgtcgtaccaacgtacttcgttacgttcttaaccgtccg

SEQ ID NO: 439336 - DNA, 608 bp, Homo sapiens
  misc_feature: GZ8MTXP01D5ME1.52.67.G01.1.454.CMB.2.raw
  modified_base (257)..(257): a, c, t, g, unknown or other
  modified_base (274)..(274): a, c, t, g, unknown or other
  modified_base (282)..(282): a, c, t, g, unknown or other
  modified_base (296)..(296): a, c, t, g, unknown or other
  modified_base (310)..(310): a, c, t, g, unknown or other
  modified_base (347)..(347): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacacgccgcctccatctcctgcaggtctagtcaaggtccttgtttcagtgataggaaacnctatgaattgtcacagngcagcacncagctactaattanagttcagcgatcgnggtccagacagactcgagccggacagggtcgggtacngggctaacgttgtaacttttccgcaattcgaacaaagttcggaaggggtcgggggtggacggagtaggaggtagttggtttaggggtttattaacgtggatagtggaataaacgggtacacgacgttcgggccttaccggaaggttccggaaccgaaagggggaaacccgtaaagggttacgggtaaaattaccgaaaaacggtacgttggttcgggaccttggacccaacgtacgttcgttacgtcctttaacgttcccg

SEQ ID NO: 439337 - DNA, 621 bp, Homo sapiens
  misc_feature: GZ8MTXP01CHFKD.52.67.G01.1.454.CMB.2.raw
  modified_base (392)..(392): a, c, t, g, unknown or other
  modified_base (420)..(420): a, c, t, g, unknown or other
  modified_base (577)..(577): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctccctggacacgccgcctccatctcctgcaggtctagtcaaggtccttcgttttcagtgataggaaactacctacttgaattggttcaccagacggccaggccaacctcgaacggcgtaccttaatttagtaaggtttctaaggcggactcgtggggtcccagacagattcgacgcggcaggtggtcaaggcaacgtgtactttcncactgactaaatcgaggcggggtagcgngtggacggtagttgggtttaggggtttattacgtgactagtacggtacgtaaaggtaccacgtacgtcgccgtaccggtacgttccgggaacggaacgggtacgtaacggggtaacgtaaaattaccgaaaaacggccgttagggtcgacggttacncccgtaacgtacttctcgttacttctaacttcccgttaaccccg

SEQ ID NO: 439338 - DNA, 602 bp, Homo sapiens
  misc_feature: GZ8MTXP01CACF3.52.67.G01.1.454.CMB.2.raw
  modified_base (401)..(401): a, c, t, g, unknown or other
  modified_base (465)..(465): a, c, t, g, unknown or other
  modified_base (571)..(571): a, c, t, g, unknown or other
  modified_base (578)..(578): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtccttcgttttcagtgataggaaactacctacttgaattggtcacagacggccaggaccaacctccgaaggccgtaccttaaatttagtaacggtttcaaggcgggtactcggtcggggtccagacagtattcacggcggcgaggtcgggtcaagggctaatgtatttccnctactgacaaatcgagggcgggggtagagtcgtagggaggtagttgggtttagggttattacgngactagtgggactaagggtacacgtacgtccggccgtccggaccgttcggaacccgtaaagggaccgaagggtaagaaacttacgaaaccgttagtggcgacgttnactaacnttctgtcttcaacttccgtaaccc

SEQ ID NO: 439339 - DNA, 692 bp, Homo sapiens
  misc_feature: GZ8MTXP01EBZ5Z.52.67.G01.1.454.CMB.2.raw
  modified_base (454)..(454): a, c, t, g, unknown or other
  modified_base (665)..(665): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccacgtggggatgttataatgactcagtctccactctccctgcccgtctccttggacagccgcctcatctcctgcaggtctagtcaacggtccttcgttttcagttagagtacggaaactaccttacttagtaatttcggttacaccgaaggacggccgaaccggacccaacccgtaccgaaacgggtaccgtaacctttaaacttttaagttaaacggttttaccgtaaaggtccggggtaaccgttccggtacgggggttaccccaggtaacacgtaacgttccgaaggcggtacgaggttacggggacncgggtctaacgttgtactttaccgtcacgtagacctaaagtcggagggtcggggtggaacggtcgtaggaggttagttcgggtttagggttaacttacgtgtagtagtaggtacgaaggttacacgtacgtcggaccgtccggtacgttaccggaccgaacgggaacgtaaggaagaaacgttacgaaaccgtagttacggcgactgaccnctacgtcgttacttcgttcgttaaccg

SEQ ID NO: 439340 - DNA, 581 bp, Homo sapiens
  misc_feature: GZ8MTXP01EZELJ.52.67.G01.1.454.CMB.2.raw
  modified_base (259)..(259): a, c, t, g, unknown or other
  modified_base (293)..(293): a, c, t, g, unknown or other
  modified_base (343)..(343): a, c, t, g, unknown or other
  modified_base (353)..(353): a, c, t, g, unknown or other
  modified_base (367)..(367): a, c, t, g, unknown or other
  modified_base (558)..(558): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccacgtggggatgttataatgactcagtctccactctccctgcccgtctccttggacagccggcctccatctcctgcaggtctagtcaacggtccttcgtttcagtgatacggaacncctatgaattcgttacacgagacgccagaccacncagctactattatagttcagcggactcgtggccagacagtcctgagcggnaggtcggtcnggctactgtcttcncgactgactaaagtccgaggggcggggtagaggtcgagggtaggtgttgggtttagggttacttaggctaggattaggacgtaaaggtcacgtacgtcgtaccgtcccgtagggttaccgaccggaaagggtaacgtaagggttacgaaacttcgaaaaccgtcggttaggcggttccaacgacaaccttnaccttaggttccttaacgtcccg

SEQ ID NO: 439341 - DNA, 581 bp, Homo sapiens
  misc_feature: GZ8MTXP02JYJ24.52.67.G01.1.454.CMB.2.raw
  modified_base (448)..(448): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactcctccctgcccgtctcccttggacagccggcctccatctcctgcaggtctagtcaaggtccttgtttcagtgatggaaactcctattgaattggttcaccagacgccaggccaactcgaggcacttaatttataaggttctaaggcggtactcgtcggggtcccagacagtactcgacggcggacgaggtcggggtcaggctacgtgtactttcacactgacaaagtcgaggcggggtagaggctaggaggtcgttagggtttgggttaattggngagtagtgacgtagtacaccgtcgtcgccgtacggacggtacgacgaacggacgtaaggtacgaaactacgaaacggtacgtcggacgctacgacctaacgtacgtcgttactccttacaccttcccgtaccg

SEQ ID NO: 439342 - DNA, 603 bp, Homo sapiens
  misc_feature: GZ8MTXP02IVUUR.52.67.G01.1.454.CMB.2.raw
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggttcaccagaggccaggccaacctccaaggccaccttaatttagtaaggtttctaaggcggactcgtcggggtcccagacagatcacgcgcaggtggtcaggcactgtatttctcactgacaaatcgaggtcggggtgaggctggaggtagttgggtttaggggtttatacgtgacgtagttagacgtaaaggacacgtacgtcggcctaccggtacggttcggacccgtaaaggggacccaagggtacggaaaataccgaaaacggtaactggtacggacctaggacctaaccctagttaccgttcgttacttcctaacgtttccccgttaccccg

SEQ ID NO: 439343 - DNA, 594 bp, Homo sapiens
  misc_feature: GZ8MTXP02ICZJU.52.67.G01.1.454.CMB.2.raw
  modified_base (257)..(257): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagcccggcctccatctcctgcaggtctagtcaaggccttcgtttcagtgatggaaacncctacttgaattggttcaccagaggccaggccaacctccaaaggcgcctaatttataaggtttcaagcgggactcgtggggtccccagacagacttcagcggcagtgggtcaggcactgatttctcactgctaaatcaggcggggtggaggctaggaggagttagggtttggggtttaattacgttgctaagttgactaaagggtacacgacgtcgggtaccctccggtacggttccggacccggaaaagggacccgtaaaggggttaggaaaacttaccgaaaacggtaaccgtggtcgacgttcggacaccgtagtccgtttggcctttacaccc

SEQ ID NO: 439344 - DNA, 549 bp, Homo sapiens
  misc_feature: GZ8MTXP02GPNME.52.67.G01.1.454.CMB.2.raw
  modified_base (366)..(366): a, c, t, g, unknown or other
  modified_base (379)..(379): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggttcaccagaggccaggcccaacctccaaggcgacctaatttataaggtttctaaggcgggactcgtggggtcccagacagactcagcgcagtggcnggcactgatttcncactgacaaatcgagcggggtgaggctggaggtagttgggttaggggtttattacgtgctagttgactaagggtacacgacgtcggccgtcgacgttcggaccgtaagggaccaagggtagaaactacgaaaacgtacgtgtaggactgcactactcgtcgtcttctacg

SEQ ID NO: 439345 - DNA, 629 bp, Homo sapiens
  misc_feature: GZ8MTXP02HUHWT.52.67.G01.1.454.CMB.2.raw
  modified_base (258)..(258): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtccttcgtttcagtgataggaaacncctacttgaattggttcaccgagacggccaggccaacctcaaaggcaccttaaatttataaggtttctaaggcgggtactcgtcggggtcccagacagtacttcgagcgcgaggtcggggtacagggcactgtacttttccgctactcgactaaagtccgaagggtcgggggtggaggtcgtaggaggtagttgggtttaggggtttacttacgttgactagttgacgtaaggtacacgtacgtcggtcccgtaccggtaccggttacggaaccgaacggggtaaccgaaagggttaacggaaaactacgaaaacgtacgtaggtacggtacgtaacggacaaccgtactcgtacgttctttaccgtaccg

SEQ ID NO: 439346 - DNA, 524 bp, Homo sapiens
  misc_feature: GZ8MTXP02HHFLA.52.67.G01.1.454.CMB.2.raw
  modified_base (367)..(367): a, c, t, g, unknown or other
  modified_base (381)..(381): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggttcaccagaggccaggccaacctccaaaggcgcctaatttataaggtttctaagcgggactctggggtcccagacagacttcagcggcagtgggtcngggcactgatttcncactgcaaatcagcggggtgaggctggaggatggttggggttattacgtgcatgcaaggtacacacgtggcctcgacgttcggaccaagggaccaagggtggaaactcgaaacgacgtgtggactgcaccatctcgtctctac

SEQ ID NO: 439347 - DNA, 579 bp, Homo sapiens
  misc_feature: GZ8MTXP02IOPPU.52.67.G01.1.454.CMB.2.raw
  modified_base (382)..(382): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgtttcagtgatggaaacacctacttgaattggttcaccagaggccaggcccaacctccaaggcgcctaatttataaggtttctaaggcgggactcgtggggtcccagacagacttcagcggcagtgggtcagggcactgatttcncactgacaaatcagcgggggtgaggctggaggagttggttggggtttattacgtggcagttgacgaaggtaccacgacgtcggccgtaccgacggtttccgggaccgaacggggaaccgaaagggtagggaaaacttaccgaaaacgaacgttaggtacggactcggaccaacctactcctagttccttactaaccg

SEQ ID NO: 439348 - DNA, 572 bp, Homo sapiens
  misc_feature: GZ8MTXP02HV8DF.52.67.G01.1.454.CMB.2.raw
  modified_base (200)..(200): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacngccggcctccatctcctgcaggtctagtcaaggccttgtttcagtgatggaaactctacttgaattggttcaccagaggccaggccaactcaaggcactaatttataaggtttcaagcgggactcgtgggtccagacagacttcagcgcagtgggtcaggcactgtatttctcactgacaaatcgaggcggggtggaggctggaggtagttggtttggggttattacgtgacgtagttgacgtaagggtacacgtacgtcggtacctccggtacgttaccgggaccgaaaacggggaccgaaaaggggttacggaaaactaccgaaaacgtacgtaggtggactaaggacaccgtatctacgttctttacac

SEQ ID NO: 439349 - DNA, 629 bp, Homo sapiens
  misc_feature: GZ8MTXP02GPZVU.52.67.G01.1.454.CMB.2.raw
  modified_base (255)..(255): a, c, t, g, unknown or other
  modified_base (365)..(365): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctgttttcagtgatggaaacncctacttgaattggttcaccagacggcagccaacctcaaggcacctaattataaggtttctaagcgggtactcgtggggtcccagacagacttcagcggcaggtgggtcngggctacgtgtatttcactacgtgactaaagtcgagggtcgggggtaggagggcgttgggaagggtagttgggtttagggggtttaatacgttggactagttagacgtaaacgggttacacctacgttcggcccgtaccggtacggttcggaccgaaacgggtacccgaaaggggtacggaaaactaccggaaaacgtacgtacggtacggacgtaacggaccgtaaccctagttacccggttacgttaccgtttaccgtaccg

SEQ ID NO: 439350 - DNA, 701 bp, Homo sapiens
  misc_feature: GZ8MTXP02J48MC.52.67.G01.1.454.CMB.2.raw
  modified_base (306)..(306): a, c, t, g, unknown or other
  modified_base (354)..(354): a, c, t, g, unknown or other
  modified_base (366)..(366): a, c, t, g, unknown or other
  modified_base (369)..(369): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgtttcagtgatggaaacacctacttgaatggtttcacccagaggccaggccaacctccaagcgcctaatttntaagttctagacggcgtctgggttccgacgacagattcacgcggccgngtggtcgacgcnctntacttctctactcgacaactcgaggtcgggtggtaggtggtagtaggtaggttaggttagggtttagggtttacggtttacgttacgtacgtacgtacgtacgtaaccgtaaccgtaccgtacccgtacccggtacccggtacccggtacccgggtacccggtacccgggtaacccgggtaaaccgggtaacccggtaaaccgggtaaaccggtaaaaccggtaaaccggtaaaccggttaaaccggtaaccggttaaccggttaccggtaaccggtaccgttacccgttacccgttacccgttacccgtttaccgtttacccgtttacccg

SEQ ID NO: 439351 - DNA, 632 bp, Homo sapiens
  misc_feature: GZ8MTXP02GVHC1.52.67.G01.1.454.CMB.2.raw
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctatgattggttcaccagagccaggccaacctccaagcgcctaattataagttcagcggactcgtcgggtccagacacgattcgacgcggcagtgggtcaggcaccgtgatttctcacgtgacaaactcgaggcgggggtgacgggcttggagtaggttggttcgggggtttaattacctggtctaaagtgtacgtaaacggtacaactaccgtcgggtcccgtcccggtaaccggtttcgggacccgaaagggggaaccccgtaaaaggggtaaagtaacgttaaaccggaaacctaaaaccgtcggttaggggaccttggaacctaacccgtaagtcctttacggtactttacccacttacccgggtttccccccg

SEQ ID NO: 439352 - DNA, 584 bp, Homo sapiens
  misc_feature: GZ8MTXP02FL8H0.52.67.G01.1.454.CMB.2.raw
  modified_base (367)..(367): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggttcaccagaggccaggccaacctccaaggcgcctaatttataaggtttctaagcgggactcgtggggtcccagacagacttcagcggcagtgggtcngggcactgatttctcactgacaaatcgagggcggggtggaggcgtggaggtagttgggttaggggtttattacgtgcagtgactaagggtacacgtacgtcggccgtcccggacgttccgggaccgaaacggggacccgaaagggttacggaaaactaccgaaaacggtaacgtaggtcggaccgtaaggacctaccattccgtagttcttactacc

SEQ ID NO: 439353 - DNA, 691 bp, Homo sapiens
  misc_feature: GZ8MTXP02IGXZC.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatcctcctgcaggtctagtcaaggccttcgtttcagttgatacggaaactaccttacttagtaaattggtttacaaccaggacggacccaaggccccaaacccgtccgaaagggtcccgtaccttaaaattttagtaaaggttttctaaaaggtccggggtaaccttcgtcgggggtaccccaagaccgaggtactttccgaaggccggacgaggttcggggtcaggggctaacgtgtaactttcctcaacttggaactaaagtccgagggcgggggtggaaggcgtagggaggtaagttgggtttagggggtttaacttacgtggtactagttgaaccgtaagggtaacacgacgttggcccgttacccggtaacgggttccggaaccgaaaacggggaacccgtaaaagggtagggaaaacttacgaaaacggtaactcggtagaccgtaagcaaacccgtactcgttctacttacgac

SEQ ID NO: 439354 - DNA, 563 bp, Homo sapiens
  misc_feature: GZ8MTXP02GM82F.52.67.G01.1.454.CMB.2.raw
  modified_base (253)..(253): a, c, t, g, unknown or other
  modified_base (297)..(297): a, c, t, g, unknown or other
  modified_base (369)..(369): a, c, t, g, unknown or other
  modified_base (433)..(433): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccgcctccatctcctgcaggtctagtcaaggtcctgtttcagtgatggaacncctactgaattgttcacagagccagccactcaagcactaattanaagttcaagcggactcgtcgggtccagacagactcagcgacaggtggtcagggcaacgttgtaactttccanacttgacctaaaatcgaaggtcgggggtagaaggctaggaggtattgggttagggttattacgngatagtagacgaagtacacgtacgtcggtacccgtacggtacgtaccggacgaaacgggtaacgaaggtacggaaaactaacgaaaacgtacgtacgcgactaacgacacgtactcgtacgtcttactcg

SEQ ID NO: 439355 - DNA, 581 bp, Homo sapiens
  misc_feature: GZ8MTXP02IU1BE.52.67.G01.1.454.CMB.2.raw
  modified_base (368)..(368): a, c, t, g, unknown or other
  modified_base (382)..(382): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgtttcagtgatggaaacactacttgaattggttcaccagacggccaggcccaacctccaaggccgacctaatttataaggtttcaagcgggactcgtcggggtcccagacagacttcagcgcagtggggcngggcactgatttcnactgacaaatcagcggggtggagctgaggattggtggggtttattacgtgctatgactaaggtacacgtacgtcggcctaccggacggtttaccgggcgaaaacggggacccgaaaagggtacgggaaaacttaacgaaaacggtaacgtaggttcgggactaacggaccaacctacttcgtcgtttacttcttaaccg

SEQ ID NO: 439356 - DNA, 558 bp, Homo sapiens
  misc_feature: GZ8MTXP02GIUMD.52.67.G01.1.454.CMB.2.raw
  modified_base (376)..(376): a, c, t, g, unknown or other
  modified_base (389)..(389): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatcctcctgcaggtctagtcaaggtccttcgttttcagtgataggaaacacctattgaattggttcaccagaggccacggccaacctccgaaaggccgaccttaaatttataaggtttctaaggcgggtactcgtcgggtccagacagactcagcgcaggtggtcngggcatgtattcncactgacaaatcgaggcggggtgaggcgtggaggtagttgggttagggtttatacgtgctagtgactaagggcacgacgtggtccctacggacgttcggaccgaaggaccgaaggtcgaaacgtacgaaaacggacgtgtaggctcgactaaccatcgtactctctacc

SEQ ID NO: 439357 - DNA, 754 bp, Homo sapiens
  misc_feature: GZ8MTXP02G0JNP.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgttttcagtgagtacggaaacctaccttacttagtaatttcgggttaccaacccgaggacggacccacggaccccaaacccgtccgaaagggtccctacccttaaagttttaagttaaaacgggttttacctaaacggtccggggtaaccttccggttacgggggtaccccaaggaaccgtagtaaccgttccgaacggccgggtacgtacggggttcggggttacccagggggacctaacgttacggtaactttttcctaccgaaactttcggaacctaaaagtcccggaaagggggtcgggggttaggaacggggtacgttaggggaagggttaggtttcgggggtttagggggtttaactttacggtggtaccgtagttcggaacgtaaacgggtaccacgtacgtcggtacccgtcggtaaccggtccggacgaaagggtaccgaagggtacgaaactacgaaaacgtcgtaggtcgaccgaagacctaaccgtatctagttacttacgtcc

SEQ ID NO: 439358 - DNA, 589 bp, Homo sapiens
  misc_feature: GZ8MTXP02J0VJI.52.67.G01.1.454.CMB.2.raw
  modified_base (256)..(256): a, c, t, g, unknown or other
  modified_base (276)..(276): a, c, t, g, unknown or other
  modified_base (287)..(287): a, c, t, g, unknown or other
  modified_base (349)..(349): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggatagccggcctccatctcctgcaggtctagtcaaggccttcgtttcagtgatggaaacncctatgaattggttcacagngccagccaacncaagcactaattataaggttcaagcgggactcgtgggtcccagacagatcagcgcagtggcngggcactgatttcgcactgacaaagtcgaggcggggtggaggcgtggaggtagttgggtttggggtttattacgtggtactagtgacgtaaacgggtacacgacgtcggacccgttaccggtaaccggtttccgggaacccgtaaaacggggaacccgtaaaaggggtaaggaaaacgttaaacgaaaacggtaacgtaggtcggacgtcggacaaccctattcgtcgttacttctaacc

SEQ ID NO: 439359 - DNA, 536 bp, Homo sapiens
  misc_feature: GZ8MTXP02IANYR.52.67.G01.1.454.CMB.2.raw
  modified_base (407)..(407): a, c, t, g, unknown or other
  modified_base (453)..(453): a, c, t, g, unknown or other
  modified_base (463)..(463): a, c, t, g, unknown or other
  modified_base (535)..(535): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagtcggcctccatctcctgcaggtctagtcaaggccttcgtttcagtgatggaacactactgaattgttcaccagagccaggccaactccaaggcgacctaatttataggtttactaagcgggtactcgtcggggtcccagacagtactcgagcggcaggtgggcagggcatgtattcacatgacaaagtcgagggcggggtggacgntggagtgttgggtttagggttatacgtggcagtgacaaggtcacgngtcgcctcgnggttcgacgtaacggacgaaggtaggaaactaccgaaaagtcgtgtcgactgaccaactctctcgttctacnc

SEQ ID NO: 439360 - DNA, 602 bp, Homo sapiens
  misc_feature: GZ8MTXP02GD2OU.52.67.G01.1.454.CMB.2.raw
  modified_base (369)..(369): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtccttcgtttcagtgatggaaacacctattgaattggttcacagacgccacgccaacctccaaggcgacctaatttagtaagttcaagcggactcgtggggtcccagacagacttcgacgcgcaggtcgggtacaggcncgtgatttccgacactgactaaatcgaggcggggtgagcgtgaggtgttggtttaggggtttatacgtgtacagttgacgtaacggtacacgtacgtcgggcccttaccggacggttaccggacgaaacgggaccgtaaggggtaacgaaacgttacgaaaacggtaccgtaggtacggactacggctaaccgtacttacgtcgttaccttacgtaccttccgtttaaccccg

SEQ ID NO: 439361 - DNA, 640 bp, Homo sapiens
  misc_feature: GZ8MTXP02HSUML.52.67.G01.1.454.CMB.2.raw
  modified_base (291)..(291): a, c, t, g, unknown or other
  modified_base (363)..(363): a, c, t, g, unknown or other
  modified_base (378)..(378): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgttttcagtgatggaaacactacttgaattggttcaccagagccagccaaccncaaggcactaatttataaggtttcaagcgggtactcgtgggcccagacagacttcgagcgcaggtggggtcngggcactgactttcnctactgacaaatcgaggcgggggtggacggtgtggaggtagttcgggtttagggggtttattaacggttgacgtagttaggacgtaaagggttaccacgacgttcggcccttaccgggtaacggtttccgggaaccgaaacggggaacccgtaaaggggttacgggaaaacttacggaaaaaccggtaacgttacgggtacggtaccgttaaggacccaaaccgtacgttccgtttaacggtttcccgtttaacgttacccg

SEQ ID NO: 439362 - DNA, 591 bp, Homo sapiens
  misc_feature: GZ8MTXP02GM2UT.52.67.G01.1.454.CMB.2.raw
  modified_base (255)..(255): a, c, t, g, unknown or other
  modified_base (292)..(292): a, c, t, g, unknown or other
  modified_base (362)..(362): a, c, t, g, unknown or other
  modified_base (395)..(395): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatcctcctgcaggtctagtcaaggtcctcgttttcagtgatggaaacnctacttgaattgttcacagagccagccactcaaggcnctaattataagttcagcggactcgtggggtccagacagattcacgcgcaggtggtcaggcactgatttcncactgacaaatcgagcggggtgaggctgaaggnttggttgggtttatacgtgactagtgacaagggtaccacgtacgtcggaccctaccggtacggttccgggacccaaacgggggaacccgtaaaggggttaacgaaaacgttaccgaaaaacggtaaaccttgggacgggtactacggaccaactaacgtcgttacggtccttacgtaccgttacctttacccccgg

SEQ ID NO: 439363 - DNA, 606 bp, Homo sapiens
  misc_feature: GZ8MTXP02GOSHO.52.67.G01.1.454.CMB.2.raw
  modified_base (364)..(364): a, c, t, g, unknown or other
  modified_base (380)..(380): a, c, t, g, unknown or other
  modified_base (444)..(444): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtccttcgttttcagtgataggaaacacctacttgaattggttcacagagccaggccaacctcaaggcactaatttataagtttcaaggcggtactcgtcgggtccagacagactcgagcggcaggtgggcngggcacgtgtacttcncactgactaaagtcgagggtcgggggtgagcgtaggaggtagttgggtttaggggttattacgngtacagttcgacgtaaggtaccacgacgttcggcccgtccggtacggttccgggaaccgaaaggggaaccgtaagggttacggaaaactaccggaaaacgtaaccgtggtaacggcccgtaaggaccctaacgtacttccgttacggttccttacttacccg

SEQ ID NO: 439364 - DNA, 795 bp, Homo sapiens
  misc_feature: GZ8MTXP02FVJBQ.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccacgtggggatgttataatgactcagtctccactctccctgcccgtctccctggacagccggcctccatctcctgcaggtctagtcaaggtccttcgtttcagtgatacggaaactacctacttgtaattcggttacaaccgtaggacggacccaacgggaccccaaaccccgtaccgaaacggggtccgtaaccctttaaaagttttaacgttaaaacgggttttaccgtaaaacggggtcccggggtaaccttccgggttaccgggggtacccccaaaggtaaacctaacgggtaacctttaccggaacggtccggggtaccgtaaggggttcggggttaccacgggggtcctaacgttggtaacctttttccgtacaaccgttagaacctaaaacgttccggaaggggtcgggggtagggaacgggtcgtagggtaagggtagtttggggtttaggggtttattacggtgacgtagttggaacgtaaacgggtaccaaccgtacggtaccgggtcccgttaccggtacgggttaccgggaaccgtaaacggggaaccgtaaaggggttacggaaaactaaccggaaaacggtaacgtcggtacgggtacctaacggaccgacttacgtcgttacgtacctttactcccg

SEQ ID NO: 439365 - DNA, 578 bp, Homo sapiens
  misc_feature: GZ8MTXP02FS9Y0.52.67.G01.1.454.CMB.2.raw
  modified_base (552)..(552): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgtttcagtgatggaaacacctacttgaattggttcaccagagccaggccaacctccaaggcgaccttaatttataaggtttcaaggcgggactcgtggggtcccagacagattcagcggcaggtgggtcagggcactgtactttcactactgacaaatcgaaggcgggggtaggaggtctggaggtagtttgggtttacggggtttaattacgtggacgtagtgaccgtaaagggttacaaccgacgtcggaccttccggaacgttcggaccgtaagggaccaaggtaggaaactacgaaacgactcgaggtacngtccaactactcgtacgtcttctacg

SEQ ID NO: 439366 - DNA, 622 bp, Homo sapiens
  misc_feature: GZ8MTXP02GZWH0.52.67.G01.1.454.CMB.2.raw
  modified_base (257)..(257): a, c, t, g, unknown or other
  modified_base (475)..(475): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccgcctccatctcctgcaggtctagtcaaggtccttcgttttcagtgatggaaacncctattgaattggttcacagacggccaggccaacctcaaggcacctaatttataagtttcaagcgggactcgtcgggtccagacagactcagcggcaggtgggtcacgggctacgtgtactttcctactactaggacaaattcggaagggccgggggttagggaacggtcgttagggagggttaagttgggtttagggggttttaattacgtcggtanagttggaccgtaaagggtaccaacgtacgtcggtcccctacggtaccgttacgggaccaaaacgggggtaccgaaagggtaggaaactaaccggaaaacgtacgtgtacggactaacggacaccgtatacgtcttaccgttacaccg

SEQ ID NO: 439367 - DNA, 752 bp, Homo sapiens
  misc_feature: GZ8MTXP02JAI9E.52.67.G01.1.454.CMB.2.raw
tcagcgcagtacgacacgaccggtgctcgatttagagtatacatattgggtttggggactgatcaggactcctcagttcaccttctcacaatgaggctccctgctcggctcctggggctgctaatgctctgggtcccagcatccactggggatgttataatgactcagtctccactctccctgccccgtctcccttggacagccggcctccatctcctgcaggtctagtcaaggtcccttcgttttcagtgataggaaacacctacttgaatttggttcaccgagacggccaggacccaacctccgaaggccgtacccttaaagttttacgtaaggttttacgtaaggtccgggacttcggtacgggggtccccaaggaccaggtacttccccgaggccggacgtagggtcggggtaccgaacgggcgacgttcggtaacttttccaccgtacttcggacctaaaacgttcggaaagggtccgggggtagggacggtacgtaggtagggttaagtttggggtttaagggggtttattaaccggtggtacctagttacggtaacgtaaaacgggttaccaacgtaacccgtacgggccctccgggtaaccggttcccggaaccggaaacggggaacccgtaaaggggtacggaaaaccttaccggaaaacgtaaacggtcggttaacggcccgttaggtaacccgaacccgtattaccggttacggttcccgtttacgtaactttacccccgg

SEQ ID NO: 439368 - DNA, 571 bp, Homo sapiens
  misc_feature: GZ8MTXP02GEHED.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgtttcagtgatggaaacacctacttgaattggttcaccagacggccaggccaacctccaaggcgacctaatttataaggtttctaagcgggactcgtcggggtccagacagacttcgagcggcaggtgggtcaggcacgtgtatttctcactgacaaatcgagggcgggggtggaggtctggaggtagttgggttaggggtttattacgtgactagtgacgtaaggtacacacgtcggccgtccgacgttcggaccgaagggacctaagggtaggaaactacgaaaacgacgtaggcggtactaagaccaactacgtctacgttccttactacc

SEQ ID NO: 439369 - DNA, 585 bp, Homo sapiens
  misc_feature: GZ8MTXP02IRLWB.52.67.G01.1.454.CMB.2.raw
  modified_base (383)..(383): a, c, t, g, unknown or other
tcagcgcagtacgacacgaccggtgctcgatttagagtatacatattgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgtttcagtgatggaaacacctacttgaattggtttcaccaggaggccacggccaacctccgaaggcgaccttaatttataaggtttcaagcgggactcgtggggtcccagacagattcagcggcaggtggtcaggcacgtgtctttcncactgactaaatcgaggcggggtgagggctgggagtagtttggttggggtttatacgtgactagtcgacgtaaggtcacgacgtcggccctccggtacggttccggacgaacggggaccaagggtacggaaaactcggaaaacgtacgtggtacgactcggaccaaccgtcttacgtcgttccttcacttcccgttaccccg

SEQ ID NO: 439370 - DNA, 627 bp, Homo sapiens
  misc_feature: GZ8MTXP02I1VPY.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtcctccactctccctgcccgtctcccttggacagcccggcctccatctcctgcaggtctagtcaaggtccttgtttcagtgatggaaacacctattgaatttggttcaccagacggccaggcccaacctccaggcaccttaatttataaggtttctaaggcgggactcgacggggtcccagacagacttcagcgctaggtgggtcagggcacgtagtactttctacactgaacaaagtccgaagggtcgggggtaggaggtctaggaggtagttgggtttaggggtttattacgtgctagtgaccaagggttaccacgtacgtcggtcccgtaccggtaccgttaccgggaccgtaaacggggaccgtaaaaggggttacgaaaacgttaacccgaaaacggtaccgttaggcgggtacctaacggacctacctacggtcgttacgttcttacttaccg

SEQ ID NO: 439371 - DNA, 585 bp, Homo sapiens
  misc_feature: GZ8MTXP02JKHYQ.52.67.G01.1.454.CMB.2.raw
  modified_base (259)..(259): a, c, t, g, unknown or other
  modified_base (399)..(399): a, c, t, g, unknown or other
  modified_base (558)..(558): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggtccttcgttttcagtgataggaaacncctacttgaatttggttacaccgagacggccaggcccaacctccaaaggccgaccttaatttagtaaggtttcaaaggcgggactcgtcggggtacccagacagacttcgagcggcaggtgggcagggcactgtatttcncactgacaaatcgaggcggggtggagctggaggtagttggtttggggtttatacgtggcagtgactaagggtacacgacgtcgggcctaccggtacggttccggacgaaacggggtaccaaaagggtacgaaaactacgaaacggtaacgtcgtggacncgacaaccagtcgtcgtcttactaccg

SEQ ID NO: 439372 - DNA, 679 bp, Homo sapiens
  misc_feature: GZ8MTXP02HGRW1.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactcctccctcgcccgtctccgtggacacgcccgcctccatcctcctgcaggtctagtacacggtccttcgtttcagtgatacggaaactaccttacttagtaagtttcggttacaccgaggacggccacggaccccaaccgtccgaaacgggcctaccttaaatttacgtaaacggttttacaaggaccgggtacttcggtcggggtacccagacagtacctcgaggcggacgtaggttcgggacgcgggtcctaacgttcggttactttcctaccaacgttacggaaactaaaacgttccgggaagggggtccggggggttaggaacgggtcgtagggggtaaggtaggtttttgggggtttacggggtttatacggtgtactaggttacgacgtaacgggtacaacgtcggtcggtccgtacggtacgtcggacgtaacgggaacgaggtacgtaaacacgaaacgtcacggtgactcgaccactagtctcgttctactaccg

SEQ ID NO: 439373 - DNA, 632 bp, Homo sapiens
  misc_feature: GZ8MTXP02G7CHC.52.67.G01.1.454.CMB.2.raw
  modified_base (380)..(380): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccttggacagccggcctccatctcctgcaggtctagtcaacggtccttcgttttcagtgataggaaacactacttgaattggttcaccaggacggccaggccaacctcgaaggcaccttaatttaataggtttactaaggcgggtactcggtcggggtacccagacagacttcgagcggcaggtcggtcnggcacgtgtatttcactactgacaaatcgaggcgggggtggaggctaggaggtagttgggtttagggggtttaatttacgtggtacgtagtacggactaacgggtacaaccgtaccgtcgggtccgttacccggacggttaccgggaaccggaaacggggaaccgaaaggggttagaaaacgttaaccgaaaacggtaacgtcggtaggacccttaaggaccctacgtactacgtactttctaccgttaccg

SEQ ID NO: 439374 - DNA, 649 bp, Homo sapiens
  misc_feature: GZ8MTXP02HVYW5.52.67.G01.1.454.CMB.2.raw
  modified_base (210)..(210): a, c, t, g, unknown or other
  modified_base (298)..(298): a, c, t, g, unknown or other
  modified_base (633)..(633): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctccttggacagccgctcatcncctgcaggtctagtcaaggtccttgtttcagtgatagaaactctatgattggttcacagcgcagccactcaagcactaattatagttnaagcgggatcgtggggtacccagacagtacttcgaacggtcggcgtaggtcggggttacgacgggtctaacttggtactttttacgctaacgttgaacctaaaagtccggaagggccgggggttagggaacgggtacgttagggtaagggttaggtttagggtttagggggttttaaactttaaccggttgggtactaaggtttacggaacgtaaaacgggttaccaacgtaccgtacggtaccggtaccgtaccggttaaccggacggaaaacggtaaccggtaaagttaggaaactaacgtaaacggacgtagtacgacgtaacgacaacctntacgtcttctactccg

SEQ ID NO: 439375 - DNA, 641 bp, Homo sapiens
  misc_feature: GZ8MTXP02IQFVI.52.67.G01.1.454.CMB.2.raw
  modified_base (393)..(393): a, c, t, g, unknown or other
  modified_base (412)..(412): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcctgacagccgctccatctcctgcagtctagtcaggtccttcgtttcagtgatagaaactacctacgttgtaattggttacaccagacgccaggaccccaaccctccgaaacgggtccgtacccttaaattttaacgttaaaggtttccaaggtccgggtactcgtcggggtaccagacagtactcgagcggcaggtcggtcncgggcacttcgtatttccnctactgactaaatccgaggcggggtaggagcgtggaggtagttggggttacgggtttaattctgtctagttggacctaagggtaccacgtacgtcggcccttaccggacggttaccggaaccgtaacgggtaacccggaaagggtaacgggtaaaactaaccaaaaccggtaacgttggacgtacggtaacaccgtacccttagttccttcgtttcctttactaacccg

SEQ ID NO: 439376 - DNA, 587 bp, Homo sapiens
  misc_feature: GZ8MTXP02HYCSA.52.67.G01.1.454.CMB.2.raw
  modified_base (258)..(258): a, c, t, g, unknown or other
  modified_base (356)..(356): a, c, t, g, unknown or other
  modified_base (377)..(377): a, c, t, g, unknown or other
  modified_base (399)..(399): a, c, t, g, unknown or other
  modified_base (415)..(415): a, c, t, g, unknown or other
  modified_base (468)..(468): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacacgccggcctcatcctcctgcagtctagtcaaggtccttcgtttcagtgataggaaacncctattgaattggttcaccagcgccagccactccgacgcgtctaattatagttacgtacgacggcgtcgtcgggcacgacgacactacgacgcggcgngtacggtgcggacacgtagtnttcgtctacacacgtaaatggngacggggtggacggtntgagggtattggttggggttacttatcggatattgcgtaaacggtaccgtaanccgtacgggccctacggttccggtaacggccgaacgggtaacgaacggtagaaaacgtacgtaaaacctacgtagcggtacgtaaccgccgaaccgtactcgttacgttcttacgtacg

SEQ ID NO: 439377 - DNA, 595 bp, Homo sapiens
  misc_feature: GZ8MTXP02G47WK.52.67.G01.1.454.CMB.2.raw
  modified_base (299)..(299): a, c, t, g, unknown or other
  modified_base (351)..(351): a, c, t, g, unknown or other
  modified_base (377)..(377): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccgcctccatctcctgcaggtctagtcaaggtccttcgttttcagtgatggaaacacctacttgaattggttcaccagaggccagccaactccaggcnctaatttataagttcaagcgggctcgtgggtcccagacagacttcagcggtnaggtgggtcagggcactgtatttccncaactgactaaatcgaggcgggggtggaggcgtggaggtatgggtttaggggtttattacgttgacagttgacgaaagggttacacgacttacggccgtaccgaccggttccggacgaaacgggacccgaaagggttacggaaaactcgaaaaacggtacgttacggtcgtaccgtaacgaccctaacccgtaattccgttagtccctttaactaccg

SEQ ID NO: 439378 - DNA, 668 bp, Homo sapiens
  misc_feature: GZ8MTXP02FJAX8.52.67.G01.1.454.CMB.2.raw
  modified_base (380)..(380): a, c, t, g, unknown or other
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctctgcaggtctagtcaaggtcctcgttttcagtgataggaaacacctacttgaatttggttcaccagaggccacggaccaacctccaaggccgtaccttaatttataaggtttcaaggcgggtactcgtcggggtcccagacagacttcagcggctaggtcgggtcnggcactgtactttctactactgactaaagtcgagggcggggtaggacgggtcgtggaggtagttcgggtttaggggttttattacgtggtactagttggaccgtaaagggtacaccgtacgtcggtccccgtaccggtaccgttccggggaccgtaaacgggggtaacccgaaaaggggttacggtaaaaacgtaacccgtaaaaaccggtaacggttacgggtacggtacgtaaccggtacccgtaacccgttacgttccgtttacggttccctttaccgtaccccg

SEQ ID NO: 439379 - DNA, 627 bp, Homo sapiens
  misc_feature: GZ8MTXP02HD4QH.52.67.G01.1.454.CMB.2.raw
tcagcgcagtacgacacgaccggtgctcgatttagagtatacatattgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggccttcgttttcagtgataggaaacacctattgaattggttacaccagacggtccaggcccaacctccgaaaggccgacttaaactttagtaacggttttcaagcgggtactcgtgggtcccagacagacttcagcgacaggtggtcaggcagtgacttctcactgacaaatcgagcgggggtgacggctaggagtagttggttaggggtttatacgtgtacagttgacgtaagggtaccaacgtacgtacggtaccctaccggtacggttaccggaccgaaaacggggaaccctaaaaggggttcgaaaaacgttaaccgaaaaacggtaccttagggtcggaccgtaacgaaccgtaccgtaactttaccgtcggtttacttacccgtaaccg

SEQ ID NO: 439380 - DNA, 508 bp, Homo sapiens
  misc_feature: GZ8MTXP01B109D.45.40.D07.1.454.CMB.2.raw
  modified_base (357)..(357): a, c, t, g, unknown or other
  modified_base (361)..(361): a, c, t, g, unknown or other
  modified_base (375)..(375): a, c, t, g, unknown or other
  modified_base (493)..(508): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagtattttgtgatgggccgattcgccatctccagagacaatgccaaagaactccctgcttctgcaacttaatgccctgagagacgaggactcggcttctttacttctgtgccgtagggggttatagtcgcgcggctcctctccggtctttgatctcgtgggccaaagggacaaggtcaccgtctctcagccctcacaggcccatccggtcttccccccccgnggcncctgctacgaggcnccacccgtcgagacgcacgcgccggcccgtgggctcgccgtggtacaacggtaccttaccttccgtcgacgtcgcgttcggtggacgggcgggcgtcggacgaacggcgacgagtagnnnnnnnnnnnnnnnn

SEQ ID NO: 439381 - DNA, 543 bp, Homo sapiens
  misc_feature: GZ8MTXP01DZMHC.45.40.D07.1.454.CMB.2.raw
  modified_base (385)..(385): a, c, t, g, unknown or other
  modified_base (531)..(543): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgaccaaagaacctccctgctttctgactaacttaatcgccctgagagacgaggactcggcttctttacttctgtgccgtagggggttatagtcgcgcggctccttcggtctttgatctcgtgggacaaggacaggtcaccgtctctcacgcctccaacgacgggccctagtccggtccttcccccgtggcctcctgccctccgaagggcnccacctcccggaagacgccacgacggcccggtccccgtggggcctcggcccgttgggtaaccaaacgggttacccttaccgttcccgtacggtactccggcgttcgtggggacgggcggggtcctagggacaacgggcgcaagtgnnnnnnnnnnnnn

SEQ ID NO: 439382 - DNA, 525 bp, Homo sapiens
  misc_feature: GZ8MTXP01C2NBS.45.40.D07.1.454.CMB.2.raw
  modified_base (375)..(375): a, c, t, g, unknown or other
  modified_base (456)..(456): a, c, t, g, unknown or other
  modified_base (506)..(525): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagtatttttgtgatgggccgattcgccatctccagagacaatgccaaagaactccctgcttctgacaaacttaatgccctgagagacgaggactcggcttctttacttctgtgccgtaggggttatagtcgcgcggctcctctccggttctttgatctcgtgggccaaagggacaaggtcaccgtctcttcacgccctccaccgaacggcccagtccggtccttcccccccccgtggccnccctgccctaccgaggcgccaccgtccgagcgaccacacggccggcccgtgggctcgccgtggacaaagtccttacttccncgatccgcgttcgtggacggtccgggcgtcggacgaacggcgacgatagnnnnnnnnnnnnnnnnnnnn

SEQ ID NO: 439383 - DNA, 562 bp, Homo sapiens
  misc_feature: GZ8MTXP01D3E1A.45.40.D07.1.454.CMB.2.raw
  modified_base (372)..(372): a, c, t, g, unknown or other
  modified_base (542)..(562): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgaccaaagaacctccctgcttctgactaaacttaatcgccctgaagagacgaggactcggcttctttacttctgtgccgtaggggttatagtcgcgcgtctcctttcggtctttgatcgtcgtgggacaaggacaagggtccaccgtctcttcacgccctcccaacgaacgggccctagtccggtcccttcccccgnggccctcctgccctcccgaaggacgcccacccgtcggagacgccaacgcggcccggcccgtgggcctcgccgtaggtacaaacggtccttacctcccgtacgacgtccggtcgttcgagggggacgggtccggggtcgtacgggacgaaacgggcccgaacgtaagtgtnnnnnnnnnnnnnnnnnnnnn

SEQ ID NO: 439384 - DNA, 490 bp, Homo sapiens
  misc_feature: GZ8MTXP01DTLG4.45.40.D07.1.454.CMB.2.raw
  modified_base (367)..(367): a, c, t, g, unknown or other
  modified_base (371)..(371): a, c, t, g, unknown or other
  modified_base (375)..(375): a, c, t, g, unknown or other
  modified_base (439)..(439): a, c, t, g, unknown or other
  modified_base (474)..(474): a, c, t, g, unknown or other
  modified_base (479)..(490): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagtatttttgtgatgggccgattcgccatctccagagacaatgccaaagaactccctgcttctgactaacttaatcgccctgagagacgaggactcggcttctttactctgtgccgtaggggttatgtcgcgcggctcctctccggttctttgactcgtcgtggggaccaaagggacaaggtcaccgtctcttcacgccctaccacgacggcccatcggtcctccccccgngccncctnctccgagcgcacccgcgagcgcacgcgccgcctgggctcgccgtggtacacgtactaccgtccncgatcgcgtgtggcggcggcgtggcgaaggccganagtgnnnnnnnnnnnn

SEQ ID NO: 439385 - DNA, 562 bp, Homo sapiens
  misc_feature: GZ8MTXP01C3N63.45.40.D07.1.454.CMB.2.raw
  modified_base (200)..(200): a, c, t, g, unknown or other
  modified_base (400)..(400): a, c, t, g, unknown or other
  modified_base (543)..(543): a, c, t, g, unknown or other
  modified_base (545)..(545): a, c, t, g, unknown or other
  modified_base (547)..(562): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagatttttgtgatgggccgattcgccatctccagagacaatgaccaaagaacctccctgcttcngacaacttaatgccctgagagacgaggactcggcttctttactctgtcgaccgtaggggttatagtcgcgcggtctccgtttccggtcttttgacttctcgtcggggaccaagggacgaaagggtccaccgtctcttcacgcctcccaacgacgggcccatccggtccttcccccgtgcccgcctgccctccgaacggcncccacccgtccgacgacgccgactacgggcccgggccctggggcctcggccgttggtaccgaaacgggtaccttaccttcccgtacgactccggcgttcgtcggggacggggccgggtcgtcgggacgaacgggccgagaagngngnnnnnnnnnnnnnnnn

SEQ ID NO: 439386 - DNA, 541 bp, Homo sapiens
  misc_feature: GZ8MTXP01DGMJD.45.40.D07.1.454.CMB.2.raw
  modified_base (495)..(495): a, c, t, g, unknown or other
  modified_base (529)..(541): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagtatttttgtgatgggccgattcgccatctccagagacaatgaccaaagaactccctgccttctgcaacttaatgccctgagagacgaggactcggcttctttacttctgtgccgtaggggttatgtcgcgcggctcctctccggttctttgatctcgtggggccaaagggacaaggtccaccgtctctcacgtccctaccaccgaacggcccagtcccggtccttccccccccccgtggccgtcccctgccctcccgaagggcgccaacccgtccggagacgccacgacggcccgggtcccgtgggcctcgccgtggtacgaaacgggtccttaccttccgccgtagtccgcgttcgnggacggcgggcgtgggacgaacggcgacagtagnnnnnnnnnnnnn

SEQ ID NO: 439387 - DNA, 509 bp, Homo sapiens
  misc_feature: GZ8MTXP01BMZEO.45.40.D07.1.454.CMB.2.raw
  modified_base (366)..(366): a, c, t, g, unknown or other
  modified_base (452)..(452): a, c, t, g, unknown or other
  modified_base (477)..(477): a, c, t, g, unknown or other
  modified_base (496)..(509): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagattttgtgatgggccgattcgccatctccagagacaatgcccaagaacctccctgcttctgcaacttaatgccctgagagacgaggactcggcttctttacttctgtgccgtaggggttatagtcgcgcggctcctctccggttctttgatctcgtggggccaaagggcaagggtcaccgtctcttcagccctccaccaacgggcccatccggtccttccccccccgnggccgcccctgccctacccgaggcgccaccctccgagacgcaacgcgccggccctgggctggccctggtaccaaggtctacttccncgacttcgcgtcgtggcggccgggntcggcgaaggccgcagtgnnnnnnnnnnnnnn

SEQ ID NO: 439388 - DNA, 548 bp, Homo sapiens
  misc_feature: GZ8MTXP01D260T.45.40.D07.1.454.CMB.2.raw
  modified_base (209)..(209): a, c, t, g, unknown or other
  modified_base (276)..(276): a, c, t, g, unknown or other
  modified_base (281)..(281): a, c, t, g, unknown or other
  modified_base (286)..(286): a, c, t, g, unknown or other
  modified_base (358)..(358): a, c, t, g, unknown or other
  modified_base (399)..(399): a, c, t, g, unknown or other
  modified_base (521)..(521): a, c, t, g, unknown or other
  modified_base (526)..(533): a, c, t, g, unknown or other
  modified_base (535)..(548): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagtattttgtgatgggccgattcgccatctccagagacaatgccaagaacctccctgcttctgctaacttaancgccctgagagacgagactcgcttctttactctgtgccgtagggttatgtcgcgcgctctctcgttntttgntctgngggaccaaggacgaaggtcaccgtctctcacgtccctacgaaccgacggccagtccggtcctccccccccgnggcctcccgtgccctaccgaggcgcccacccgtccgagacncacgcggcccggcccgtggggctcgcccgtaggtaccgaaacggttccttaccgttccctacggactccgggtccgttcgggtaggacgggccggggctcgggaaccgaacggggtccgaanagtgnnnnnnnngnnnnnnnnnnnnnn

SEQ ID NO: 439389 - DNA, 581 bp, Homo sapiens
  misc_feature: GZ8MTXP01CUIN6.45.40.D07.1.454.CMB.2.raw
  modified_base (203)..(203): a, c, t, g, unknown or other
  modified_base (228)..(228): a, c, t, g, unknown or other
  modified_base (537)..(538): a, c, t, g, unknown or other
  modified_base (540)..(542): a, c, t, g, unknown or other
  modified_base (544)..(545): a, c, t, g, unknown or other
  modified_base (547)..(550): a, c, t, g, unknown or other
  modified_base (552)..(552): a, c, t, g, unknown or other
  modified_base (554)..(556): a, c, t, g, unknown or other
  modified_base (558)..(565): a, c, t, g, unknown or other
  modified_base (567)..(578): a, c, t, g, unknown or other
  modified_base (580)..(581): a, c, t, g, unknown or other
tcagacgcgatcgacacgaccggtgctcgatttagtgatagagcgtaacaacaggagggggggggcaatttatgaaacccgaaaggacatggccttgggggtgggtagggacatagggacagatgccagcctgaggtggagcctcaggacacaggtgggcacggacaccatccacataagcgagggacagacccgagtgtccngcagcagactgagagcgccggccanacgcctccgacgggccctgcctcgtccctctcgacggtccacgccctaggaccacgttccccgggtacccaggccagctcgccctaccaccgacggccccagttccccgtaccttccccccgtgacccctcccgtaccctaccgaacgacgccaacccgtcggtcggggactaaccccgcggaccggtcccgtcgggcctaccggtcccgtcggtaccgtaaacgggtaccctttacgtcccctacgacgtcgtacccgttcgacgggtcgggcggtaccggttacgggaccgtacgggtcacgaaggnngnnngnngnnnngngnnntnnnnnnnngnnnnnnnnnnnngnn

SEQ ID NO: 439390 - DNA, 531 bp, Homo sapiens
  misc_feature: GZ8MTXP02GGF37.45.40.D07.1.454.CMB.2.raw
  modified_base (468)..(468): a, c, t, g, unknown or other
  modified_base (516)..(531): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagtattttgtgatgggccgattcgccatctccagagacaatgccaaagaacctccctgcttctgcaacttaatcgccctgagagacgaggactcggcttctttacttctgtgccgtaggggttatagtcgcgcggctcctctccggtctttgatctcgtggggaccaagggacaagggtccaccgtctcttcacgccctaccaccgaacgggccctagtccggttccttccccccccgtggcccgtccctgcctccgaggcgccaccgtccgagacgcacgcggccgcccgtgggcctcggcccgtggtaccaacggtaccttaccgttccncgactccgcgtcgtggacggcgggtcgtgggaccaagggcgcaagtgnnnnnnnnnnnnnnnn

SEQ ID NO: 439391 - DNA, 435 bp, Homo sapiens
  misc_feature: GZ8MTXP02GGBJ5.45.40.D07.1.454.CMB.2.raw
  modified_base (430)..(435): a, c, t, g, unknown or other
tcagacgcgatcgacacgaccggtgctcgatttagtgatagagcgtaacaacagaggggggcaatttatgaacccgaaaggacatggccttggggtgggtagggacatagggacagatgccagcctgaggtggagcctcaggacacaggtgggcacggacaccatccacataagcgagggacagacccgagtgttcctgcagcagacctgagagcgccgggcccacagccttccctaggggccctgctgcctcctcaggtcagccctggacatcccggttccccaggcccagatgcctccaccaaggcccatcggtctcccctggccaccctcctccaagacgccacctctggggcaccagccggccctgggctgcctgggtcaaggctactcctcgatcgcgtctgagcgggctggcaaggcgcatagnnnnnn

SEQ ID NO: 439392 - DNA, 479 bp, Homo sapiens
  misc_feature: GZ8MTXP02GO9HM.45.40.D07.1.454.CMB.2.raw
  modified_base (359)..(359): a, c, t, g, unknown or other
  modified_base (470)..(470): a, c, t, g, unknown or other
  modified_base (475)..(479): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaagaacctccctgcttctgcaacttaatgccctgagagacgaggactcggcttctttacttctgtgccaggggttatagtcgcgcggctcctttccggtctttgatctcgtggggccaagggacaaggggtcaccgtctcttcagcctccaccgaagggccccagtcggtccttcccccgnggccgccctgcctccaggcgccacctccggagacgcacacggccggcccgtggggctgccgtggtcaaggacttacttcctcgatcgcgtctgaggcggctgggcaaggcncatgnnnnn

SEQ ID NO: 439393 - DNA, 524 bp, Homo sapiens
  misc_feature: GZ8MTXP02GYV4H.45.40.D07.1.454.CMB.2.raw
  modified_base (287)..(287): a, c, t, g, unknown or other
  modified_base (378)..(378): a, c, t, g, unknown or other
  modified_base (401)..(401): a, c, t, g, unknown or other
  modified_base (500)..(500): a, c, t, g, unknown or other
  modified_base (507)..(524): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagtattttgtgatgggccgattcgccatctccagagacaatgaccaaagaacctccctgcttctgcaaacttaatcgccctgagagacgaggactcggcttctttactctgtcgcgtaggggttatagtcgcgcggctcctcgtccggttntttgatctcgtggggccaagggacaagggtccaccgtctcttcacgccctaccaaccgaacgggcccctagtccggtccttccccccccgnggccctccctgcctaccgaggcncccacctcgagcgcacgcgccgccgtggctcgccgtgtacaaggtactacgttccacgatccgcgttctggacggtccgggcgtcggacgaaggccganagtacgnnnnnnnnnnnnnnnnnn

SEQ ID NO: 439394 - DNA, 537 bp, Homo sapiens
  misc_feature: GZ8MTXP02GBE64.45.40.D07.1.454.CMB.2.raw
  modified_base (404)..(404): a, c, t, g, unknown or other
  modified_base (522)..(537): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaagaacctccctgcttctgcaacttaatgccctgagagacgaggactcggcttctttacttctgtgccgtaggggttatagtcgcgcggctcctctccggtcttttgatctcgtggggccaagggacaagggtcaccgtctcttcacgccctccaccaacgggccccatccggtccttccccccccgtggccgcccctgcctcccgaggcgccaccctccgagacncacacgccggcccgtggggcctcggcccgttggtaccaaacgggtaccttacctttcccgtacgtacttccggccgttcgtcgggaggccggggcgtgggaccgaacgggcgcagagnnnnnnnnnnnnnnnn

SEQ ID NO: 439395 - DNA, 551 bp, Homo sapiens
  misc_feature: GZ8MTXP02GXDKV.45.40.D07.1.454.CMB.2.raw
  modified_base (537)..(551): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaagaactccctgcttctgcaacttaatgccctgagagacgaggactcggcttctttacttctgtgccgaggggttatagtcgcgcggctcctctccggttcttttgatctcgtggggccaagggacaagggtcaccgtctcttcacgccctaccaccgaacggccccatccggtccttccccccccgtggccgccctgcctccgaggcgccacccgtccgagacgcacgacggtcccgcccgtggggcctcggcccgttagggtaccaaacgggtcctttaaccgttcccgtacgacgttccggccgttcttacgggacggccggggtacgtcggggaccgaacgggccgacaagtagnnnnnnnnnnnnnnn

SEQ ID NO: 439396 - DNA, 517 bp, Homo sapiens
  misc_feature: GZ8MTXP02G20P0.45.40.D07.1.454.CMB.2.raw
  modified_base (397)..(397): a, c, t, g, unknown or other
  modified_base (416)..(416): a, c, t, g, unknown or other
  modified_base (459)..(459): a, c, t, g, unknown or other
  modified_base (501)..(517): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaagaactccctgcttctgcaacttaatcgccctgagagacgaggactcggcttctttacttctgtgccgtaggggttatagtcgcgcggtcttcctttccggtcttttgatctcgtggggaccaagggacaaggggtccaccgtctccttcacgccctccaaccgaacgggccccagttccggtcccttcccccgtggcccgcccctgcctccgaggcnccacctcggagacgcacgngcccgcccgtgggcctcgccgtggtaccaaggtcctacttccncgactcggcgtctggacggcggctgggacaaggcgcaagtgnnnnnnnnnnnnnnnnn

SEQ ID NO: 439397 - DNA, 467 bp, Homo sapiens
  misc_feature: GZ8MTXP02HUMAI.45.40.D07.1.454.CMB.2.raw
  modified_base (358)..(358): a, c, t, g, unknown or other
  modified_base (380)..(380): a, c, t, g, unknown or other
  modified_base (455)..(455): a, c, t, g, unknown or other
  modified_base (458)..(467): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaaagaactccctgcttctgcaacttaatgccctgagagacgaggactcggctctttactctgtgccaggggttatagtcgcgcggctcctctccggtctttgatctcgtggggccaagggacaagggtcgccgtctctcagcctccacaagggcccatcggtccttcccccccgtggccnccctgctccagcgcacctcganagcacagcgcctgggctgcctgtcaaaggactacttcctcgactcgcgtctgagcgggctggcaaacggcgctanagnnnnnnnnnn

SEQ ID NO: 439398 - DNA, 568 bp, Homo sapiens
  misc_feature: GZ8MTXP02IB1H1.45.40.D07.1.454.CMB.2.raw
  modified_base (258)..(258): a, c, t, g, unknown or other
  modified_base (393)..(393): a, c, t, g, unknown or other
  modified_base (545)..(545): a, c, t, g, unknown or other
  modified_base (547)..(548): a, c, t, g, unknown or other
  modified_base (550)..(559): a, c, t, g, unknown or other
  modified_base (561)..(568): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagattttgtgatgggccgattcgccatctccagagacaatgccaagaactccctgccttctgctaacttaatgccctgagagacgaggactcggcttcttttactctgtgccgaggggttanagtcgcgcggctcctctccggtctttgatctcgtggggccaagggacaagggtccaccgtctcttcagtccctaccaccgaacgggccccagtccggtcctccccccccgtggcccgccctgcctcccgagggcnccctacctcccggaagacgccaacacggcccggtcccgtggggcttcggacccgtggtacaaacgggtaccttaaccgttcccgtacgactccggtccgtccgtagggacggccggggcgtacggggacgaaaggggccgacgaaagttagngnncnnnnnnnnnngnnnnnnnn

SEQ ID NO: 439399 - DNA, 549 bp, Homo sapiens
  misc_feature: GZ8MTXP02IZJQR.45.40.D07.1.454.CMB.2.raw
  modified_base (529)..(529): a, c, t, g, unknown or other
  modified_base (531)..(549): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatctccagagacaatgccaaagaactccctgcttctgcaacttaatgccctgagagacgaggactcggcttctttacttctgtgccgtaggggttatagtcgcgcggctcctctccggttcttttgatctcgtggggccaagggacaagggtccaccgtctcttcacgccctccaccgaacgggcccagtccggtccttccccccccgtggcctcccctgcctcccgaggcgccaccctccgagacgccacgacggccggccctggggcctcggccctgggtacaacgggtaccttaccgttccctacgacttccggccgttcgtgggacggccggggtctaggggaccgaaagggccgacgtaagtgngnnnnnnnnnnnnnnnnnnn

SEQ ID NO: 439400 - DNA, 552 bp, Homo sapiens
  misc_feature: GZ8MTXP02H24FN.45.40.D07.1.454.CMB.2.raw
  modified_base (286)..(286): a, c, t, g, unknown or other
  modified_base (367)..(367): a, c, t, g, unknown or other
  modified_base (436)..(436): a, c, t, g, unknown or other
  modified_base (533)..(552): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagtattttgtgatgggccgattcgccatctccagagacaatgccaagaactccctgcttctgcaaacttaatgccctgagagacgaggactcggcttcttttactctgtgccgtaggggttatagtcgcgcggctcctctccgttctttgntctcgtcgggccaagggacaagggtcaccgtctctcacgccctaccaccgaacggccctagtccggtcccttcccccccgngggcccgtcccctgtcctaccgaggcgccctaaccgtccgagacgcacgacgccggcccgtggggtccngcccgtggtacgaacggtacttaccttccgtacgacgttccgccggttcgtagggcggccggggtcgtacgggaccgaacggggcccagaagttggnnnnnnnnnnnnnnnnnnnn

SEQ ID NO: 439401 - DNA, 426 bp, Homo sapiens
  misc_feature: GZ8MTXP02F2UWQ.45.40.D07.1.454.CMB.2.raw
  modified_base (304)..(304): a, c, t, g, unknown or other
  modified_base (309)..(309): a, c, t, g, unknown or other
  modified_base (324)..(324): a, c, t, g, unknown or other
  modified_base (340)..(340): a, c, t, g, unknown or other
  modified_base (393)..(393): a, c, t, g, unknown or other
  modified_base (414)..(414): a, c, t, g, unknown or other
  modified_base (420)..(426): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtcctcccatctactacgcagattttgtgatgggccgattcgccatcgagagacgaggactcggctctttacttctgtgccaggggttatagtcgcgcggctcctctccggtcttttgatctcgtggggccaagggacaagggtcaccgtctcttcagcctccaccaaggcccatcggtccttccccnggccnccctgctccaggacncacctccgagcgcacngccggccctgggccctgccctggtcaaggaccttacttccgtcgatcgcgtcnggacgcgggctggcaagggcncatagnnnnnnn

SEQ ID NO: 439402 - DNA, 473 bp, Homo sapiens
  misc_feature: GZ8MTXP02IQ2GX.45.40.D07.1.454.CMB.2.raw
  modified_base (317)..(317): a, c, t, g, unknown or other
  modified_base (320)..(320): a, c, t, g, unknown or other
  modified_base (351)..(351): a, c, t, g, unknown or other
  modified_base (355)..(355): a, c, t, g, unknown or other
  modified_base (373)..(373): a, c, t, g, unknown or other
  modified_base (391)..(391): a, c, t, g, unknown or other
  modified_base (429)..(429): a, c, t, g, unknown or other
  modified_base (459)..(459): a, c, t, g, unknown or other
  modified_base (461)..(461): a, c, t, g, unknown or other
  modified_base (463)..(473): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagattttgtgatgggccgattcgccatctccagagacaatgccaagaactccctgcttctgcaacttaatgccctgagagacgaggactcggctctttactctgtgccaggggttatagtcgcgcggctcctctccggtcttttgactctcgtggggaccaagggacaagggtcacgtctntcngcctcacacggccatcgtcctccccctgccncccngctccagcgcacctcgangcacagcggccctgggcngcctgtacaacggtactccttaccgtcgatcgtcgttntcgggacgcggggctggggacagggccgananannnnnnnnnnn

SEQ ID NO: 439403 - DNA, 445 bp, Homo sapiens
  misc_feature: GZ8MTXP02HJPAK.45.40.D07.1.454.CMB.2.raw
  modified_base (404)..(404): a, c, t, g, unknown or other
  modified_base (438)..(445): a, c, t, g, unknown or other
tcagacgcgatcgacacgaccggtgctcgatttagtgatagagcgtaacaacaggagggggggcaatttatgaacccgaaaggacatggccttgggggtgggtagggacatagggacagatgccagcctgaggtggagcctcaggacacaggtgggcacggacaccatccacataagcgagggacagacccgagtgttcctgcagcagacctgagagcgccgggccacagccttcccgagggccctgctgcctctcagtcagccctggacatcccgggttccccaggccagatcgcctccaccaagggccccatccggtcttccccctggccacccgtcctccaacgacgcacctcgtcggggcaccgacgcggccctgggctgcctggtcaaggctacttccncgatcgcgtctgagcgggctggcaggcgcatagnnnnnnnn

SEQ ID NO: 439404 - DNA, 556 bp, Homo sapiens
  misc_feature: GZ8MTXP02F3TW7.45.40.D07.1.454.CMB.2.raw
  modified_base (147)..(147): a, c, t, g, unknown or other
  modified_base (391)..(391): a, c, t, g, unknown or other
  modified_base (412)..(412): a, c, t, g, unknown or other
  modified_base (427)..(427): a, c, t, g, unknown or other
  modified_base (529)..(529): a, c, t, g, unknown or other
  modified_base (538)..(556): a, c, t, g, unknown or other
tcagacgcgatcgacacgaccggtgctcgatttagtgatagagcgtaacaacagagggagtagagtcctgaggactgtaggacagccgggagtgggttgcaggcatcagccctggtggtccctcccatctactacgcagtattttgngatgggccattcgccatctccagagacaatgccaaagaacctccctgcttctgcaacttaatgccctgagagacgaggactcggtcttctttacttctgtgccgtaggggttataggtcgcgcggtctcctcgtccggttctttgacttctcggtggggaccaagggactaaggtccaccgtctcttcacgtccctccaccgaacgggccctagttccggtcccttccccccccgtgggccccncccgtgccgtacccgagggcncccaccgtccgagcncacgcgcgtcccgtgggacctcgccgtggtacaaacggtaccttaccgtcctcgactccggccgtcgtacggacggtccgggcgtcgggacgtaacgggccncgtaatcgnnnnnnnnnnnnnnnnnnn

SEQ ID NO: 439405 - DNA, 607 bp, Homo sapiens
  misc_feature: GZ8MTXP02GK8K0.45.40.D07.1.454.CMB.2.raw
  modified_base (197)..(197): a, c, t, g, unknown or other
  modified_base (284)..(284): a, c, t, g, unknown or other
  modified_base (582)..(582): a, c, t, g, unknown or other
  modified_base (588)..(607): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtcggccctcccatctactacgcagattttgtgatgggccgattcgccatctccagagacaatgccaaagaactccctgcttcngcaacttaatgccctgagagacgaggactcggcttctttacttctgtgccgtaggggttataggtcgcgcggctcctcgtccggttntttgatctcgtcggggaccaagggacaacgggtccaccgtctccttcacgtccctacccaaccgaaacgggcccctaagtcccgggttcccttccccccccccgtcggggcccctcccccgtcggtcccttacccgagggtaccgccctacccgtcccggaagaccgaccaccgacggcccgggtccccgtgggggtcctcggtacccggttggggtaaccaacggggtaccttaccgtttcccacgtacgttcccggacggtttcagggcggccggggtctcgggaccgaggccganagtagnnnnnnnnnnnnnnnnnnnn

SEQ ID NO: 439406 - DNA, 517 bp, Homo sapiens
  misc_feature: GZ8MTXP02FTT72.45.40.D07.1.454.CMB.2.raw
  modified_base (279)..(279): a, c, t, g, unknown or other
  modified_base (283)..(284): a, c, t, g, unknown or other
  modified_base (290)..(290): a, c, t, g, unknown or other
  modified_base (325)..(325): a, c, t, g, unknown or other
  modified_base (356)..(356): a, c, t, g, unknown or other
  modified_base (361)..(361): a, c, t, g, unknown or other
  modified_base (499)..(517): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagatttttgtgatgggccgattcgccatctccagagacaatgccaagaactccctgcttctgcaacttaatgccctgagagacgaggactcgcttctttacttctgtgccgtaggggttatagtcgcgcgctcctctccggtntttnntctcgnggggccaaggcaagggtccacgtctctcacgcccnccacgacggccagtccggtccttccccccgnggccncctgcctaccgaggcgccaccgtcggacgcgacacgacgcccgccgtgggcctgcccgttggtacgaacggtaccttaccgttccacgacttccggtcgtcgtaggcggcgggtctacgggcgaacggcgactagagnnnnnnnnnnnnnnnnnnn

SEQ ID NO: 439407 - DNA, 528 bp, Homo sapiens
  misc_feature: GZ8MTXP02GUS4H.45.40.D07.1.454.CMB.2.raw
  modified_base (291)..(291): a, c, t, g, unknown or other
  modified_base (385)..(385): a, c, t, g, unknown or other
  modified_base (391)..(391): a, c, t, g, unknown or other
  modified_base (414)..(414): a, c, t, g, unknown or other
  modified_base (419)..(419): a, c, t, g, unknown or other
  modified_base (441)..(441): a, c, t, g, unknown or other
  modified_base (481)..(481): a, c, t, g, unknown or other
  modified_base (495)..(495): a, c, t, g, unknown or other
  modified_base (511)..(528): a, c, t, g, unknown or other
tcagacgcgatcgacacgaccggtgctcgatttagtgatagagcgtaacaacagagggagtagagtcctgaggactgtaggacagccggagtgggttgcaggcatcagccctggtggtccctcccatctactacgcagtattttgtgatgggccgtattcgccatctccagagacaatgaccaaagaacctccctgccttctgactaaacttaatcgccctgagagacgaggactcggcttctttacttctgtcgccgtaggggttatagcgcgcgcctcctcgtccgttntttgactctcgtcggggacaagggacgaaggtccaccgtctcttcacgtccctacgaaccgaacggcccctagtcccggtaccttcccccccgnggcccnccctgcctaccgagtcgccaccncgganacgcacgtcgcccgccgtggcncgtacgtgtacgacgtaccttacgtcctacgatccgcgtntcggacgcggtcgngaccgaggcacagtgnnnnnnnnnnnnnnnnnn

SEQ ID NO: 439408 - DNA, 571 bp, Homo sapiens
  misc_feature: GZ8MTXP02FNAKG.45.40.D07.1.454.CMB.2.raw
  modified_base (547)..(570): a, c, t, g, unknown or other
tcagacgcgatcgacacgaccggtgctcgatttagtgatagagcgtaacaacaggaggggggggggcaatttatgaacccgaaaggacatggccttggggtgggtagggacatagggacagatgccagcctgaggtggagcctcaggacacaggtgggcacggacaccatccacataagcgagggacagacccgagtgttcctgcagcagacctgagacgccggccgggcccacgacgcccttcccgacggggccctgctcgccctctcaggtcacgcccgtgacacgttcccggttcccacggccagactcgccctacccaaccgacgggaccccagtcccggttcccttcccccccgtcggccctacccccgtcctacccgaacgccgccctaaccgtcggtcgggggaccacccgaccggtcccggcccgttcggggcctcggtccccgttgggacccgtaaaggtacccttaccgtttcccgcggtacgtcgtccgtcgtcggtacggccgggtcgtcgggacgacggtcgactaacgcagtnnnnnnnnnnnnnnnnnnnnnnnnc

SEQ ID NO: 439409 - DNA, 536 bp, Homo sapiens
  misc_feature: GZ8MTXP01EUDIW.11.26.C04.1.454.CMB.2.raw
  modified_base (368)..(368): a, c, t, g, unknown or other
tcagcgagagataccacgaccggtgctcgatttagtctagcgactttgggtttgggggaggcttggtccagcctgggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccgttcaccatctccagagacaacgccaagaatgcgatatatctacagatgaacagcctgcgagccgaggacacggctgtgtattactggtgggatccctggctggcacctgtactccgacgttggagtcaagggaactcnggtcaccgtctcctcagccctccaccaacgggcccatccggtccttcccccgtcggccgcccctcgcctccgaggacgccgacctcccgagacgcacgagccggccctgggctgccgtggtcaaggactacttccgtatcttcttcgctgagcgggctggcaaggcgc

SEQ ID NO: 439410 - DNA, 550 bp, Homo sapiens
  misc_feature: GZ8MTXP01DSRUN.11.26.C04.1.454.CMB.2.raw
  modified_base (330)..(330): a, c, t, g, unknown or other
  modified_base (464)..(464): a, c, t, g, unknown or other
  modified_base (547)..(547): a, c, t, g, unknown or other
  modified_base (549)..(549): a, c, t, g, unknown or other
tcagcgagagataccacgaccggtgctcgatttagtctagcgactttgggtttggggaggcttggtccagcctggggggtccctgagactctcctgtacagcctctggattcagcatcagttcgtattggatgaattgggtccgccaggctccagggaaggggctggagtgggtggccaacataaagccagatggagtgtaaaacagtatgtagactctgtggagggccgttcaccatctccagagacaacgccaagaatgcgatatatctaacagatgaacagcctgcgagccgaggacacggctgtgtattactggtgggacttcccnggctggcacctgtactccgacgttgagtcaagggactcgtggtccacccgtctcctcagccctccaccaacggcccagtcgtcccttcccctcggcgccctcgcctccgagcgcgaccctccggagacgcacgngccggcccgttggggttcgccgtcggtcaaacggtcttacgttccgttattctcttcgcttgcggcgggcgtggcgaggccgngng

SEQ ID NO: 439411 - DNA, 506 bp, Homo sapiens
  misc_feature: GZ8MTXP01D5LOL.11.26.C04.1.454.CMB.2.raw
  modified_base (337)..(337): a, c, t, g, unknown or other
  modified_base (413)..(413): a, c, t, g, unknown or other
  modified_base (442)..(442): a, c, t, g, unknown or other
  modified_base (481)..(481): a, c, t, g, unknown or other
tcagcgagagataccacgaccggtgctcgatttagtctagcgactttgggtttgggaggcttggtccagcctggggtccctgagactctcctgtacagcctctggattcagcatcagttcgtattggatgaattgggtccgccaggctccagggaagggctggagtgggtggccaacataaagccagatggaggtgtaaaacagtatgtagactctgtggaggccggttcaccatctccagagacaacgccaagaatgcgatatatctacagatgaacagcctgcgagccgaggacacggctgtgtattactgtggatccctggctggcactgtacnccgacgttggatcaagggactctggtcaccgtctcctcagccctccaccaagggcccatcggtcttccccctggcnccctgctccagacgcacctcgagagcacngcggccctgggctgcctggtcaaggctacttccgtatcncttcgctgagcggctggcaaggcgc

SEQ ID NO: 439412 - DNA, 528 bp, Homo sapiens
  misc_feature: GZ8MTXP01CTG7K.11.26.C04.1.454.CMB.2.raw
  modified_base (329)..(329): a, c, t, g, unknown or other
  modified_base (512)..(512): a, c, t, g, unknown or other
  modified_base (528)..(528): a, c, t, g, unknown or other
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggagtcccnggctggcactgtactccgacgttggatcaagggaactcgtggtcaccgtctcctcacgccctccaccaacgggcccatccggtccttccccgtcggccgccctcgcctccgacggacgcacctccgagacgcacacgcgcccgtggctgcctggtcaaggctacttcgtatcttcttcgctgngcggctggcaaggcgn

SEQ ID NO: 439413 - DNA, 572 bp, Homo sapiens
  misc_feature: GZ8MTXP01BXICM.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggatccctggctggcacctgtactccgacgttggagtcaagggactgtggtccaccgtctcctcacgccctccaccgaacgggcccacgtccggtcccttcccccgtcggcccgccctcgcctccgacggacgccgaccgtccgagacgccacgacggccggcccgtggggtcctcggccgtgggtcaacgggttacttaccgttccgtactcttcgttcgcgtggcggcgggcgtggcaacggcgaac

SEQ ID NO: 439414 - DNA, 573 bp, Homo sapiens
  misc_feature: GZ8MTXP01DQ9KA.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacgtgtgggatccctggctggcacctgtactccgacgttggatcgaagggaactcgtggtccacccgtctccctcacgccctccaccaacgggccccatccggttcccttcccccgtggcccgcccctcgcctccacggacgccacccgtccgagacgcacgacgccggcccgtgggcctcggcccgtggtaaccaacgggaccttaccgttccgtactcttcgttcgcgtggaggcgggctgggcgaacggcgaacg

SEQ ID NO: 439415 - DNA, 566 bp, Homo sapiens
  misc_feature: GZ8MTXP01AFA1X.11.26.C04.1.454.CMB.2.raw
  modified_base (548)..(548): a, c, t, g, unknown or other
  modified_base (566)..(566): a, c, t, g, unknown or other
tcagcgagagataccacgaccggtgctcgatttagtctagcgactttgggtttgggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaaagaatgcgatatatctacagatgaacagcctgcgagccgaggacacggctgtgtattactggtgggatccctggctggcacctgtactccgacgttggagtcaagggactcgtggtccaccgtctcctcacgccctccaccgacgggcccacgtccggtccttcccccgtcggcccgtcccctcgcctccgacgggacgccgacccgtccgagacgccacgcggccggcccgtcggggctcggcccgtgggtcaacggttacctacgttccgtactcttcgttcgctggngcgggctgggcaaggcgn

SEQ ID NO: 439416 - DNA, 570 bp, Homo sapiens
  misc_feature: GZ8MTXP01DDUUQ.11.26.C04.1.454.CMB.2.raw
  modified_base (391)..(391): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatgggagtgtaaaacagtatgtagactctgtggagggccgttcaccatctccagagacaacgccaagaatgcgatatatctacagatgaacagcctgcgagccgaggacacggctgtgtattacgtggtggacgtccctggctggcactgtactccgacgttggagtcgaaagggaactcgtggtccaccgtctccctnacgccctccaccaacgggcccatccggtcccttccccgtggccgccctgcctccgaggcgccacccgtccgagacgcacgacggccggcccgtggggctcggcctgggtaacaaggcttacgttccgtattccttcgttccgcgtcggacggccgggcgtgggacgaacgggcgtaacg

SEQ ID NO: 439417 - DNA, 660 bp, Homo sapiens
  misc_feature: GZ8MTXP01EQ3QP.11.26.C04.1.454.CMB.2.raw
  modified_base (209)..(209): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattacgtggtgggacgttcccgtggctggcctacctgtacctccggtacggttggacgtcgaagggtactcgtggtccacccgtctcctcacgccctacccaccgaacgggccccacgttcccggttccctttccccccgtcgggtcccgccccgtcgcccgtcccgaacgggaccgacccggaccccgttcccggaacggaccgaccgaaccgaccgggcccgggtccccgtcggggtccgttcggcccgttcgggtaacgtaaacggttaccttacccgtttccggtacttccgttccgttcgttcgtggacggccggggtcgtcgggaccgtaacgggcgaacg

SEQ ID NO: 439418 - DNA, 670 bp, Homo sapiens
  misc_feature: GZ8MTXP01CJY5Z.11.26.C04.1.454.CMB.2.raw
  modified_base (247)..(247): a, c, t, g, unknown or other
  modified_base (253)..(253): a, c, t, g, unknown or other
  modified_base (414)..(414): a, c, t, g, unknown or other
tcagcgagagataccacgaccggtgctcgatttagtctagcgactttgggtttgggggaggcttggtccagcctgggggggtccctgagactctcctgtacagcctctggattcagcatcagttcgtattggatgaattgggtccgccaggctccgaggggaaggggctggagtgggtggccaacataaagccagatggaggtagtaaaacagtatgtagactctggtggagggccgttcaccatcnccaganacaatgaccaagaatgcatatatctaacagatagaacagcctggaccgagcccgaggacgacggctgtagttattacgtggtgggacgtccgtggctcggcaccgtgtacgtccgtacggttggacgtacgagggtaacctcgtcggtcctacccgtcccnccgtcaccctccctacccgaaccggaccggtcccctaccggttccccgtttcccccgttccccggtccgtccccgtcccgttccgcccgtaccgacgggtaccaccccgtacccggacggacgacgaccgacgaccggcccggtccggtcggtccgtccggtccggtaacggtaacgaacggttaccttccgttaccgtcgttccttcgttccgtcggtcgggaacgggtccggtcggttacggaacgaacgggcg

SEQ ID NO: 439419 - DNA, 603 bp, Homo sapiens
  misc_feature: GZ8MTXP01A477B.11.26.C04.1.454.CMB.2.raw
  modified_base (208)..(208): a, c, t, g, unknown or other
  modified_base (574)..(574): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctggtggagggccggttcaccatctccagagacaacgccaagaatgcgatatatctacagatgaacagcctgcgagccgaggacacggctgtgtattacgtggtgggacgtccctgggctggcacgtgtactccgacgttggagtcgaaagggactcgtggtcacccgtctcctcacgccctccaccgaacgggcccacgtccggtcccttcccccgtggcccgtcccctcgacctccgaggccgccaccctccggacgacgccaccgacggccggccccgtggggccttcggcccgttgggtccgaaacgggttcctttaaccgttccgtattcccttcgttcgcgttaacggnggccgggtacgtcggacgtaacggcgaac

SEQ ID NO: 439420 - DNA, 583 bp, Homo sapiens
  misc_feature: GZ8MTXP01AIC4Z.11.26.C04.1.454.CMB.2.raw
  modified_base (206)..(206): a, c, t, g, unknown or other
  modified_base (308)..(308): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaagggctggagtgggtgccaacataaagccagatggaggtgtaaaacngtatgtagactctgtggagggccgttcaccatctccagagacaacgccaaagatgcgatatatctacagatgaacagcctgcgagccgaggacacggctgtntatactggtggactccctggctggctaccgtgtactccgacgttggagtcgaagggaactcgtggtccaccgtctcctcacgccctccaccgaacggcccacgtccgtccttcccccgtgccgccctcgcctccgacgacgccaccgtccggagacgaccacgcgccggtcccgcgggtcctcggtccgtggtaacgaaacggttaccttaccgttccgtaactccgttccgttcggttcgtaacggcggccgggtcgcggacgaacggccgaag

SEQ ID NO: 439421 - DNA, 577 bp, Homo sapiens
  misc_feature: GZ8MTXP01EZNEJ.11.26.C04.1.454.CMB.2.raw
  modified_base (430)..(430): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggagtgtaaaacagtatgtagactctggtggagggccggttcaccatctccagagacaacgccaaagaatgcgatatatctaacagatgaacagcctgcgagccgaggacacggctgtgtattactggtgggacgtccctggctggcacctgtactccgacgttggagtcgaaagggactcgtggtccaccgtctcctcacgccctccaccacggcccagtccgtccttccccgnggccgccctcgcctccgacggacgccgacccgtccggagacgccaccgacggccggcccgtgggctcggccgtggtaacaacggttaccttaccgttccgtactccttcgttcgcgtggacggcgggcgtcgggacaagggcgaacg

SEQ ID NO: 439422 - DNA, 710 bp, Homo sapiens
  misc_feature: GZ8MTXP01EFZIB.11.26.C04.1.454.CMB.2.raw
  modified_base (253)..(253): a, c, t, g, unknown or other
  modified_base (282)..(282): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaaagccagatgggaggtagtaaaacagtatgtagactctgtgggagggccgttcaccatctccaganacaacgccaaagaatgacgatatatctanagatgaacagcctgcgagccgaggacacggctgtgtattacgtggtgggacgttcccgtggtcgtcggcctaccgttgttaaccgtcccggtacggttgggacgtccgtaaaaggggaaccttcggtcgggtcccacccgttcctaccctcgacgtcccctccaacccgaaccgggccctacgttcccggttccctttcccccgtcgggcccgtccccgtggacccgtcccgaacgggaccgcccgtaacccgtacccggaacgaccgaccgaaccgaccgggcccggtaccccggttcggggcccgtcggtcccgttcggggttaaccgaaacggttacccgtttacccgtttcccggtaacttcccgttccgttccgttccgttgggtacggccggggttacgcgggaccgtaacgggcccgtaag

SEQ ID NO: 439423 - DNA, 534 bp, Homo sapiens
  misc_feature: GZ8MTXP01AB8J0.11.26.C04.1.454.CMB.2.raw
  modified_base (182)..(182): a, c, t, g, unknown or other
  modified_base (209)..(209): a, c, t, g, unknown or other
  modified_base (384)..(384): a, c, t, g, unknown or other
  modified_base (416)..(416): a, c, t, g, unknown or other
  modified_base (419)..(419): a, c, t, g, unknown or other
  modified_base (425)..(425): a, c, t, g, unknown or other
  modified_base (427)..(427): a, c, t, g, unknown or other
  modified_base (514)..(514): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtgccaanataaagccagatggaggtagtaaaacngtatgtagactctggtggagggccgttcaccatctccagagacaacgccaagaatgcgatatatctacagatagaacagcctgcgagccgaggacacggctgtagtattactggtggacgtccctggctggcacgtgtactccgacgttggatcaagggactgtggtccacgtcnctcacgccctcacacggccatccgtctcccgngcncctgcncngacgcacctcgagacgcacgacgtccggcccgtgggtcctcgcccgtggtcaaaggttcctacttccgtatccgttcttcgactggngtcgggctggacgaaggcgc

SEQ ID NO: 439424 - DNA, 620 bp, Homo sapiens
  misc_feature: GZ8MTXP01A7OUV.11.26.C04.1.454.CMB.2.raw
  modified_base (212)..(212): a, c, t, g, unknown or other
  modified_base (254)..(254): a, c, t, g, unknown or other
  modified_base (480)..(480): a, c, t, g, unknown or other
  modified_base (497)..(497): a, c, t, g, unknown or other
tcagcgagagataccacgaccggtgctcgatttagtctagcgactttgggtttgggggaggcttggtccagcctgggggggtccctgagactctcctgtacagcctctggattcagcatcagttcgtattggatgaattgggtccgccaggctccgaggggaaggggctggagtgggtggccaacataaagccagatggaggtagtaaaacngtatgtagactctggtggacgggccgttcaccatctccaganacaacgcaagatgcgatatatctacagatagaacagcctggacgacggaccggaggaccacggtcttggttagtactttacgtgggtcgggtacgtcccgtgggcctcggcctacgtgtaccgtcccggtacgttggacgtcgaaagggtactcgtcggtccacccgtcctcctcacgtccctcccaaccgaaccgggccctacgtcccggttcccttcccccggngcccgtccctcgtcccnccggacggaccgcccaccgtccgagacgcacgcgcccggccgcggtcctcgccgtcgtaacgaacggttcctcgttccgtactcttcgttcgcgtggccggcggacgtggacgaacgggcaag

SEQ ID NO: 439425 - DNA, 549 bp, Homo sapiens
  misc_feature: GZ8MTXP01BRFG0.11.26.C04.1.454.CMB.2.raw
  modified_base (210)..(210): a, c, t, g, unknown or other
  modified_base (222)..(222): a, c, t, g, unknown or other
  modified_base (249)..(249): a, c, t, g, unknown or other
  modified_base (308)..(308): a, c, t, g, unknown or other
  modified_base (431)..(431): a, c, t, g, unknown or other
  modified_base (448)..(448): a, c, t, g, unknown or other
  modified_base (461)..(461): a, c, t, g, unknown or other
  modified_base (476)..(476): a, c, t, g, unknown or other
  modified_base (514)..(514): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaaagccagatggaggtagtaaaacngtatgtagactntgtggagggccgttcacatctccaganacaacgcaagaatgcgatatatctacagatgaacagcctgcgagcgagacacggctgtntatacgtgtggacgtcctggctaggcctacgtgtaccgtccgacggttggactcgaaagggaactcgtgtccacccgtctcctcacgccctaccaccgacggcccagtccgtcccttccccgngcctccctgcctcagcncgaacctcgacgngccacgcgccgccgnggcctgccgtggcaacggttacctacgttccgtatccncgttcgcgtggcgcggtgcggacgaacggccgaag

SEQ ID NO: 439426 - DNA, 661 bp, Homo sapiens
  misc_feature: GZ8MTXP01CEQJS.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacagtatgtagactctgtggagggccggttcaccatctccagagacaacgccaagatgcgatatatctacagatgaacagcctgcgagcgagacacggctgtgtattacgtggtgggacgtcccgtggcctggcctaccgtgtaccctcccggtacggttggacgtcggaaacggggtaaccttcgtcggtcccacccgttctcccgtcacgcccctacccaccgaaccgggccccagtcccggtcccttcccccgtcggcccgtccctgccctaccgacggaccgccgacccgtccggagaccggaccaccggaccggcccggtccccgtcgggtcctccggcccgttacgggtaacccgaaacgggttaccttaacccgtttccgttaacttcccttaccgttccgttccgttgggacggtccgggcgtcggggacgtaacggggccaacgg

SEQ ID NO: 439427 - DNA, 649 bp, Homo sapiens
  misc_feature: GZ8MTXP01DMBSW.11.26.C04.1.454.CMB.2.raw
  modified_base (449)..(449): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatgggagtgtaaaacagtatgtagactctgtggagggccggttcaccatctcagagacaacgcaagaatgcatatatctacagatagaacagcctgacgagcgagacacggctgtgtattacgtggtgggcgtcccgtggcttggccacgtgtacctccgtacgtggagtcgaagggactcgtgtccaccgttctcctcacgccctacccgaacgaaccgggccctacgtccggttcccttcccccgtcggtcccncccgtcgcctccgacggacgcccgacccgtccggaacgacgtaccgaccgacggcccgggtccccgtggggtcctacggtcccgttacgggtaacgtaaaccggttacccgtttaccgttacccgttacttcccttccgttccggttccgtaacgggacgggccggggtacggtacgggaccgtaaacggggcccgtaag

SEQ ID NO: 439428 - DNA, 655 bp, Homo sapiens
  misc_feature: GZ8MTXP01ADNPC.11.26.C04.1.454.CMB.2.raw
  modified_base (212)..(212): a, c, t, g, unknown or other
  modified_base (278)..(278): a, c, t, g, unknown or other
  modified_base (508)..(508): a, c, t, g, unknown or other
  modified_base (650)..(650): a, c, t, g, unknown or other
tcagcgagagataccacgaccggtgctcgatttagtctagcgactttgggtttgggggaggcttggtccagcctgggggggtccctgagactctcctgtacagcctctggattcagcatcagttcgtattggatgaattgggtccgccaggctccgagggaaggggctggaggtgggtggccaacataaagccagatggaggtagtaaaacngtatgtagactcgtggtggagggtccgttcacatctcagagacaacgcaagatgcgatatatctanagatagaacagcctggacgaggtaccggaggaccacggtcgttaggtcgttaagttaccgtgggtacgggggtaccgttcccggtgggtccttacgggacctaccgttggttaacccgttccccgggacggtttgggaacgtacggaaacggggtaaccttcgtcgggtacctaccggtcctcctcacgtccctaccgaccgacgggccctacgtccgtcccttccccgngccctcccgtgcctacgacgcgaccgtaccgccgagaccgccacgcggtcccgccgtcgggcctcgccgtggaaccaacggttactccggttctacgtccttcgttcgcgtaagggcgaacgggtcgacgggcgtaacgggntaacg

SEQ ID NO: 439429 - DNA, 507 bp, Homo sapiens
  misc_feature: GZ8MTXP02IPEFE.11.26.C04.1.454.CMB.2.raw
  modified_base (375)..(375): a, c, t, g, unknown or other
  modified_base (443)..(443): a, c, t, g, unknown or other
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaagggctggagtgggtggccaacataaagccagatggaggtgtaaacagtatgtagactctgtggagggccggttcaccatctccagagacaacgccaagaatgcgatatatctacagatgaacagcctgcgagcccgaggacacggctgtgtattactgtggatccctggctgcactgtactccgacgttggatcagggactctgtcaccgtctcctnacgccctccacaacggcccatcggtcttcccctcggcgccctgctccaggacgcacctcgagagcacngcgcctgggctgcctggtcaaggactacttccgtactctctcgctgacgcggctggcaaggcgc

SEQ ID NO: 439430 - DNA, 558 bp, Homo sapiens
  misc_feature: GZ8MTXP02IJALT.11.26.C04.1.454.CMB.2.raw
  modified_base (342)..(342): a, c, t, g, unknown or other
  modified_base (381)..(381): a, c, t, g, unknown or other
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggccggttcaccatctccagagacaacgcaagaatgcgatatatctacagatgaacagcctgcgagccgaggacacggctgtgtattactggtgggatccctggctggcacctgtacnccgaccgtgagtcagggactcgtgtcaccgtctcctcanccctccaccaaacgggcccacgtccggtccctttcccccgtcggcccgtcccctcgcctccgacggacgccgacctccgagacgcacgagccggcccgtgggcctcgcctggtacaaacgggtactaaccttccgtactcctcctcgcgtggacgcgggctcggacaacgggcgacg

SEQ ID NO: 439431 - DNA, 614 bp, Homo sapiens
  misc_feature: GZ8MTXP02JLRQ7.11.26.C04.1.454.CMB.2.raw
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaagggctggagtgggtggccaacataaagccagatggaggtgtaaaacagtatgtagactctgtggagggccggttcaccatctccagagacaacgccaagaatgcgatatatctacagatgaacagcctgcgagcccgaggacacggctgtgtattactggtgggatccctggctggcacctgtactccgacgttgatcaggactctggtcaccgtctcctcagccctccaccaacgggcccacgtccggtcccttccccctcggcccgtccccgtcgcctcccgacgggacgccaaccctcccgacgacggaccaccgacgccgggccccgtcgggggcctcggtcccgtcgggttaccgaaaacgggtaccttaaccgtttcccggttaacttcccttccgttccgccgttcggacggccggggtccgttgggaccgaaacggggccggtaaccg

SEQ ID NO: 439432 - DNA, 527 bp, Homo sapiens
  misc_feature: GZ8MTXP02IXI53.11.26.C04.1.454.CMB.2.raw
  modified_base (364)..(364): a, c, t, g, unknown or other
  modified_base (509)..(509): a, c, t, g, unknown or other
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggatccctggctggcacctgtactccgacgttggatcaggaactntggtcaccgtctcctcagccctccaccaacggcccatccggtccttcccctcggccgccctgcctccaggacgccacctccgagacgcaacgacgcggcccgtggggctgcctggtcaaggctaccgttcgtactctctcgctgngcggcgtcgcgacgcgcg

SEQ ID NO: 439433 - DNA, 590 bp, Homo sapiens
  misc_feature: GZ8MTXP02JYHIQ.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggatccctggctggcactgtactccgacgttgagtcagggactcgtggtcaccgtctcctcacgccctccaccaacgggcccagtccggtcccttcccccgtggcccgcccctcgcctccgacggcgccaccgtcccgagacgcacgacggtccggccccgtggggcctcggcccgtcgggtaccgaaacgggtaccttaaccgtttcccggtacttccgtccgtccggccgtggacggtccggggctcggggacgaacggggcgacg

SEQ ID NO: 439434 - DNA, 557 bp, Homo sapiens
  misc_feature: GZ8MTXP02GZYD8.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggccggttcaccatctccagagacaacgccaagaatgcgatatatctacagatgaacagcctgcgagccgaggacacggctgtgtattactgtgggagtccctggctggcacctgtactccgacgttgagtcaggactctggtcaccgtctcctcacgccctccaccaacggcccatccggtccttccccctcggccgcccctcgcctccgacggacgccaccctccgacgacgcaccgacgccggcccgtgggcctcggcccgtggtaccgaacgggtaccttaccgttccgtactcctcctcgctgacgcgggctggcgaacggcgacg

SEQ ID NO: 439435 - DNA, 564 bp, Homo sapiens
  misc_feature: GZ8MTXP02F3RY6.11.26.C04.1.454.CMB.2.raw
  modified_base (209)..(209): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacngtatgtagactctgtggagggccgttcaccatctccagagacaacgccaagaatgcgatatatctacagatgaacagcctgcgagccgaggacacggctgtgtattactggtggactccctggctggcactgtactccgacgttgagtcaggactcgtgtcaccgtctcctcacgccctccaccgaacggcccactccgtcccttcccccgtcggccgccctcgacctccgacggacgccacccgtccgacgacgaccaccgacggccggcccgtggccgtcgccgtcggtacgaacggtaccttaccgttccgtactctccgtcgcgtcgacggcggcgtggacgacggcgacg

SEQ ID NO: 439436 - DNA, 544 bp, Homo sapiens
  misc_feature: GZ8MTXP02I6KCM.11.26.C04.1.454.CMB.2.raw
  modified_base (208)..(208): a, c, t, g, unknown or other
  modified_base (382)..(382): a, c, t, g, unknown or other
  modified_base (416)..(416): a, c, t, g, unknown or other
  modified_base (421)..(421): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctggtgtattacgtggtggggatccctggctggccactgtactccgacgttgatcaggactgtgtcaccgtctccncagccctccaccacggcccatcgtcccttccccnggccnccctgcctccgaggacgccacccgtcgacgagcacgacgccggcccgtgggctcgcctggtaccaggtacctacgttccgtactcctcgtcgcgtggacggccgggctcggacgacggcgacg

SEQ ID NO: 439437 - DNA, 583 bp, Homo sapiens
  misc_feature: GZ8MTXP02JRO0A.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgcaagatgcgatatatctacagatgaacagcctgcgagccgaggacacggctgtgtattacgtggtgggagtcccgtggctggcctaccgtgtacctccgacgttggagtcagggactcgtggtcaccgtctcctcacgccctccaccgaacgggcccacgtccggtcccttcccccgtcggccgtccctcgcctccgacggacgaccacccgtccgagacgcacgacggccggcccgtgggcctcgcccgtcgggttacaaacgggtaccttaccgttcccgtacttccgtcttcgccgtggacggcgggcgcggccgaacggcgacg

SEQ ID NO: 439438 - DNA, 575 bp, Homo sapiens
  misc_feature: GZ8MTXP02FSVIK.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctaacagatgaacagcctgcgagccgaggacacggctgtgtattactggtggagtccctggctggcacctgtactccgaccgttggagtcagggaactcgtggtcaccgtctcctcacgccctccaccgaaacgggcccacgtccggtcccttcccccgtcggcccgcccctcgcctccgaggacgccaccctccgagacgaccaccgacggcccggcccgtcgggcctcgcccgtcggtacgaacggtaccttaccgttccgtactcctctcgtctggacggcggcgtcggacaagggcacg

SEQ ID NO: 439439 - DNA, 538 bp, Homo sapiens
  misc_feature: GZ8MTXP02J1NVS.11.26.C04.1.454.CMB.2.raw
  modified_base (206)..(206): a, c, t, g, unknown or other
  modified_base (375)..(375): a, c, t, g, unknown or other
  modified_base (417)..(417): a, c, t, g, unknown or other
  modified_base (437)..(437): a, c, t, g, unknown or other
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccgttcaccatctccagagacaacgccaagaatgcgatatatctacagatgaacagcctgcgagccgaggacacggctgtgtattacgtgtgggatccctggctggcactgtactccgacgttgagtcagggactcgtggtcaccgtntcctcacgccctccaccaacggcccatcggtccttcccccgngccgccctgctccgaggacnccacctccgagacgccacacggcggccccgtggggcctgcccgtggtccaaaggacctacgttccgtactcctctcgctgacgcggctcggcaacggcgac

SEQ ID NO: 439440 - DNA, 578 bp, Homo sapiens
  misc_feature: GZ8MTXP02GJD82.11.26.C04.1.454.CMB.2.raw
  modified_base (207)..(207): a, c, t, g, unknown or other
  modified_base (422)..(422): a, c, t, g, unknown or other
  modified_base (443)..(443): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggagtgtaaaacngtatgtagactctgtggagggccgttcaccatctccagagacaacgccaagaatgcgatatatctacagatgaacagcctgcgagccgaggacacggctgtgtattacgtggtgggactccctggctggcactgtactccgacgttgatcagggactcgtggtcaccgtctcctcacgccctccaccgaacggcccagtccggtccttcccccgnggccgccctgcctccgaggcnccacccgtccgagacgccaacgacggccggcccgtcgggcctcggcccgtggtaccgaaacgggtaccttaaccgtttccggtaacttccgtcgttccgcgttcggacggcggggactcgggacgaacggcgacg

SEQ ID NO: 439441 - DNA, 586 bp, Homo sapiens
  misc_feature: GZ8MTXP02FVJF1.11.26.C04.1.454.CMB.2.raw
  modified_base (383)..(383): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacgtggtgggagtccctggctggcacctgtactccgacgttggagtcagggactcgtggtcaccgtcncctcacgccctccaccacggcccagtccggtcccttcccccgtcggccgcccctcgcctccgacggacgccacccgtccgagacgaccaaccgacggcccggcccgtcggggcctcggccgtggtaccgaaacgggtaccttaccgtttcccgttacttccgtccgtccgtcgtggacggccgggcgtggacgaacggcgacg

SEQ ID NO: 439442 - DNA, 680 bp, Homo sapiens
  misc_feature: GZ8MTXP02IEPR7.11.26.C04.1.454.CMB.2.raw
tcagcgagagataccacgaccggtgctcgatttagtctagcgactttgggtttggggaggcttggtccagcctgggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggaggccggttcaccatctccagagacaacgccaagaatgcgatatatctacagatgaacagcctgcgagccgaggacacggctgtgtattactggtggggacgtccccgtgcgtcgacctcgtagtacccgtacccgtacggtaggtacgtacggaacggtacctcgggtccgtaccgtacccgttcctccctacgacccgtccctacccgaaaccggacccggccctacggttcccggttcccccttcccgccggccccgtcccgtcctcccgtaccggaaggacccgaccctaccccgcgaacggaccgacccgaccgaccgggccccgtcccgggtcgggtccgtaccgtcccggttcggtaaccggtaaacgttaccctttacccggtttaccgtaccttcctccgtccgttacgaaggcgggggtccggtcggacggacggaccggcgtaacg

SEQ ID NO: 439443 - DNA, 594 bp, Homo sapiens
  misc_feature: GZ8MTXP02H5BLR.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactggtgggacgtccctggctggcaccgtgtactccgacgttggagtcgagggaactcgtggtccaccgttctcctcacgccctcccaccgaacgggcccacgttccggtcccttcccccgtcggcccgcccctcgcctccgacggacgccacccgtccgacgacgaccacgacggccggcccgtcgggctcgcccgtggtacgaacggtaccttaccgtttccgtactccgtccgtccgcgtcggacggccggggtcgtcgggacgaacgggccgacg

SEQ ID NO: 439444 - DNA, 605 bp, Homo sapiens
  misc_feature: GZ8MTXP02JK818.11.26.C04.1.454.CMB.2.raw
  modified_base (208)..(208): a, c, t, g, unknown or other
  modified_base (301)..(301): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacngtatgtagactctgtggagggccgttcaccatctccagagacaacgccaagatgcgatatatctacagatgaacagcctgcgagccgaggacncggctgtgtattacgtggtggacgttcccgtggctggcactgtactccgacgttgagtcaggactcgtgtcaccgtctcctcacgccctccaccgaacgggccctacgtcccggtcccttcccccgtcggcccgtccccgtcgcccgtccgaagggccgaccgacccgtaccgacggacgccgaaccgcggcccgggcccgttcggggccgtcggtccgtcgggtaccgaaacgggtaccttaccgttaccgtacttccgtccgttcgccgttaagcggccgggtcgtcggaccgacggcgacg

SEQ ID NO: 439445 - DNA, 570 bp, Homo sapiens
  misc_feature: GZ8MTXP02F8REQ.11.26.C04.1.454.CMB.2.raw
  modified_base (209)..(209): a, c, t, g, unknown or other
  modified_base (331)..(331): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaagaatgcgatatatctacagatgaacagcctgcgagccgaggacacggctgtgtattactggtgggatcccnggctggcacctgtactccgacgttgagtcagggactcgtggtcaccgtctcctcacgccctccaccgaaacgggcccacgtcccggttcccttccccccgtggcccgtcccctcgccgtcccgacggacgccaaccgtccgagacgcacgacgccggcccgtgggctcgccgtggtcaacggtacctacgttccgtactcctcctcgctggacggtccgggctcggacgaacggcgacg

SEQ ID NO: 439446 - DNA, 602 bp, Homo sapiens
  misc_feature: GZ8MTXP02FM5E5.11.26.C04.1.454.CMB.2.raw
  modified_base (209)..(209): a, c, t, g, unknown or other
  modified_base (333)..(333): a, c, t, g, unknown or other
  modified_base (382)..(382): a, c, t, g, unknown or other
  modified_base (586)..(586): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtgtaaaacngtatgtagactctgtggaggccggttcaccatctccagagacaacgcaagaatgcgatatatctacagatgaacagcctgcgagccgaggacacgggctgtgtattactggtgggacgttcccngggctggcctaccgtgtaacctccggacgttggacgtcaggggactcgnggtcaccgttctcgtcacgccctacccacgaacgggcccacgtccggtcccttcccccgtggcccgtccccgtgcccgtccgaagggccgaccacccgtccgagacggaccacgacggcccggcccgttcggggcctcggtcccgtaggggtaccaaaacgggtccttaaccgttccggtactcctctcggctggacggcggcncggcgaacgggcaacg

SEQ ID NO: 439447 - DNA, 578 bp, Homo sapiens
  misc_feature: GZ8MTXP02IQCXF.11.26.C04.1.454.CMB.2.raw
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattacgtggtgggacgtccctggctggccaccgtgtactcccgaccgttggagtcgagggtactcgtggtccaccgtctcctcacgccctccaccaacggcccacgtccggttcccttcccccgtcggcccgcccctcgcctccgacggacgccacccgtccgagacgaccaccgacggccggcccgtgggcctcgcccgtggtaccaacggtacctacgttccgtacttcctcctcgcgtcgcggccggctcggcgacggcgacg

SEQ ID NO: 439448 - DNA, 597 bp, Homo sapiens
  misc_feature: GZ8MTXP02FPEC7.11.26.C04.1.454.CMB.2.raw
  modified_base (471)..(471): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgaggggaaggggctggagtgggtggccaacataaagccagatggaggtagtaaaacagtatgtagactctggtggagggccggttcaccatctccagagacaacgccaagaatgcgatatatctacagatgaacagcctgcgagccggaggacacgggctggtgtattacgtggtgggactcccgtgggctggactaccgtgtacctcccggaaccgttgggacgtcgtaaggggtaaccttcggtacggtcctacccgttcctcctacacgccctaccgaccgaacggcccagtcccggtcccttccccgcggccnccctgccctacgagccgccaccgtccgagacgcacgacggccggccgtcgggctcgccgtcggtacgacggtactaccgttccgtactccgtcgcgcgtaacgcggcggtcgtgggacgaggcacg

SEQ ID NO: 439449 - DNA, 596 bp, Homo sapiens
  misc_feature: GZ8MTXP02G7EBT.11.26.C04.1.454.CMB.2.raw
  modified_base (210)..(210): a, c, t, g, unknown or other
  modified_base (222)..(222): a, c, t, g, unknown or other
  modified_base (315)..(315): a, c, t, g, unknown or other
  modified_base (468)..(468): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacataaagccagatggaggtagtaaaacngtatgtagactntggtgggagggccggttcaccatctcagagacaacgcaagaatgacgatatatctaacagatagaacagcctgcgagccgagacacggctgtntatactggtggacgtcccgtggctggcctactgtacctccgacgttggacgtcgagggtactcgtcgtacaccgttcctcctcacgccctacccaccgaacggccctagtcccggtcccttccccgcggcccgccctacgcctaccgacggcnccgacccgtcgacgacgccacgacggccggccgtcgggcctcggcccgtaggtaccgaaacggttacctaccgtttccgtacttcctcgtcgcgtaacggacggccgggtactggacgacggccgacg

SEQ ID NO: 439450 - DNA, 569 bp, Homo sapiens
  misc_feature: GZ8MTXP02F98MH.11.26.C04.1.454.CMB.2.raw
  modified_base (306)..(306): a, c, t, g, unknown or other
  modified_base (434)..(434): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccagggaaggggctggagtgggtggccaacataaagccagatggaggtgtaaaacagtatgtagactctgtggagggccggttcaccatctccagagacaacgccaagatgcgatatatctacagatgaacagcctgcgagccgaggacacggntgtagtattactggtgggatcccgtggcctggctaccgtgtacctccggacgttggacgtcgagggactcgtggtccaccgttcctcctcacgccctccacgacggcccacgtccgtccgtcccccgngccgcctcgcctccgaggacgccacccgtcgacgacgcgacgacgccggcccgtcgggcgtcgccgtggtacaaggtaccttaccgttcgtactcctcgtcgtctggcggccggtacgtcggacgaacggcgacg

SEQ ID NO: 439451 - DNA, 597 bp, Homo sapiens
  misc_feature: GZ8MTXP02IST15.11.26.C04.1.454.CMB.2.raw
  modified_base (474)..(474): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaaggggctggagtgggtggccaacaataaagccagatggaggtagtaaaacagtatgtagactctgtggagggccggttcaccatctccagagacaacgccaagatgcatatatctaacagatgaacagcctgcgagtccgaggaccacggctgtgtaattacgtggtgggacgtccgtggctggacctacgtgtacctcccggtacgttggacgtcgaaggtactgtcgtccaccgtctcctcacgccctaccaccgtaacggcccacgttccgttcccttccccgtcggccgcccttcgcctaccgaggaccncccgacccgtccgagacgaccacgacgccggcccgtggggctcggcgtacggtacgaacggttacctacgtttccgtacttcctactcgtcgtggacgggcggccgtggacggaacggcgacg

SEQ ID NO: 439452 - DNA, 647 bp, Homo sapiens
  misc_feature: GZ8MTXP02G06UZ.11.26.C04.1.454.CMB.2.raw
  modified_base (210)..(210): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgaggggaagggctggagtgggtgccaaacataaagccagatggaggtagtaaaacngtatgtagactctggtgggagggcccgttacaccatcctccgagagacaacgcaaagaatgacatatatcacagatgaacagcctgcgagccgaggaccacggtctggtagttattacgtggtagggcgttcccgtggtctcggcctaccgtgtacccgtccgtaccgttggacgtcgaaggtactcgtcggtcaccgtcctcctcaccgtccctaccgaacccgaccggccctacgtcccgttcccgttcccccgtggcccgtccctcgccctaccgacggcgacccgacccgtaccgagacgacctacggacgcccggtcccgtgggtccgtacggtcccgtacggtaccgaaacgttaccgttaccttacccggtacttccgtccgttcggccgtaaggcggccggggtacgtcgggaccgaacggtccgaacg

SEQ ID NO: 439453 - DNA, 706 bp, Homo sapiens
  misc_feature: GZ8MTXP02I0ZZL.11.26.C04.1.454.CMB.2.raw
  modified_base (209)..(209): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccaggggaaggggctggagtgggtggccaacataaagccagatggaggtgtaaaacngtatgtagactctgtggagggccggttcaccatctccagagacaacgccaagaatgcgatatatctacagatagaacagcctgcgacgccgagacacggctgtgttacttacgtggtcgggtacctcccgtggccgtggcctaccgttgtacccgtcccggtaccgtttagggacgttacggaacggggtaaccttcggttcgggttacccgaccccgtttcttcccccgttacgacccggtccccttaaccccgaaccggaaacccgggtccctaaccggtttccccggttcccccgtttcccccgtcgggtccccgtccccgttacgccccgtccggaaagggcccacccgtaccccgtaccggagaccgacccgaaccgtcgggcccggtcccgtggggccttcggaccgttacgggtaaccgaaccggttaccttaccgtttccgtacttccgtccgtcgtcgtggacggtcggcgtacggacgacggcctag

SEQ ID NO: 439454 - DNA, 591 bp, Homo sapiens
  misc_feature: GZ8MTXP02GMFYU.11.26.C04.1.454.CMB.2.raw
  modified_base (184)..(184): a, c, t, g, unknown or other
  modified_base (211)..(211): a, c, t, g, unknown or other
  modified_base (390)..(390): a, c, t, g, unknown or other
  modified_base (466)..(466): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgaggggaaggggctggagtgggtggccaanataaagccagatggaggtagtaaaacngtatgtagactctggtgggagggccgttcaccatcctccagagacaacgccaagatgacgatatatctacagatagaacagcctgcgagccggaagcacggtctgtgtattacgtggtgggtactcccgtggctggcacgttgtccctccgacgttggagtcgagggtactcgtcggcnccgttctcctcacgccctaccgaccgacggccctagtcccggttccctccccgtcgccctccctgccgtcacggcnccgaccgtccgagcgactacgcggccggcccgtgggctacgccgtcggtaccgaacggttaccttaccgttccgtacttccgtcgtcgacgtggtacggccgggttcgcggacggacggactacg

SEQ ID NO: 439455 - DNA, 732 bp, Homo sapiens
  misc_feature: GZ8MTXP02JJQPG.11.26.C04.1.454.CMB.2.raw
  modified_base (181)..(181): a, c, t, g, unknown or other
  modified_base (207)..(207): a, c, t, g, unknown or other
  modified_base (445)..(445): a, c, t, g, unknown or other
  modified_base (695)..(695): a, c, t, g, unknown or other
tcagcgagagataccacgaccggtgctcgatttagtctagcgactttgggtttgggggaggcttggtccagcctggggggtccctgagactctcctgtacagcctctggattcagcatcagttcgtattggatgaattgggtccgccaggctccgagggaagggctggagtgggtgccaanataaagccagatggagtagtaaaacngtatgtagactcgtggtgggacgggtccgttcaccatctcgagaagacaacgaccaagaatgacgatatatctaacagatagaaacagccgtggacgacgaccggaaggacctacgggtgttaggttgttaacgtttacgtgggtacggggtacgttccccgtggcttcggacctaccgttagttacccgtcccgttacggtggacgtagacgggtaactcgtcggtctacccgttcncctacgccgccctacccgaaccgtaacggccctacgttcccgttaccccgttcccccgtcggaccccgttccccgacgtcccgtacccgaggggaccctcccgaaaccccggtccggaaggacccgaccgaacggggtcccggccccgggtccggtccggggtccttaccggtccggtacgggtaaacccgtaaacggttacccgtttaacccgtccgtttaaccgtcccgtccgttacgacgtccgggngggtacccgggacgtcggaaccggacgttaccgtaag

SEQ ID NO: 439456 - DNA, 494 bp, Homo sapiens
  misc_feature: GZ8MTXP01AHBPM.39.40.D07.1.454.CMB.2.raw
  modified_base (204)..(204): a, c, t, g, unknown or other
tcagtcgcactagtcacgaccggtgctcgatttagtgatagagcgtaacaacagaggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccaggctcccaggctcctcatctatgatgcctcacaggccatggtatcccagccccaggttcagtggcaaatgggtctggggacaggagttcactctcattatcagcagcctgcagtctgaagatttagctaaggtttatactgtcagcagtataatgactggcctagttcggccaagggaccaagggtgaaattcgaaacgactgtgctgcacaattctg

SEQ ID NO: 439457 - DNA, 547 bp, Homo sapiens
  misc_feature: GZ8MTXP01B85DJ.39.40.D07.1.454.CMB.2.raw
  modified_base (205)..(205): a, c, t, g, unknown or other
  modified_base (293)..(293): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaaacttagcctggtaccagcagaaacctggccaggctcccaggctccncatctatgatcgccctccaccgagggccatggtactccccagcccccaggttcaggtggactaaagtgggtctggggacaggtacgttcacttctctattatcagcagccctgcagtcagaatattagcttaaggtttattactgtacagtctagtataagtgtacgtgtctacggttcgacgttaagggaccaaagggtaggaaacttacgaaaacgttacgtggtcggctggaccttacctaattcgtaacg

SEQ ID NO: 439458 - DNA, 516 bp, Homo sapiens
  misc_feature: GZ8MTXP01B89G0.39.40.D07.1.454.CMB.2.raw
  modified_base (206)..(206): a, c, t, g, unknown or other
  modified_base (293)..(293): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgtagcagcaacttagcctggtaccagcagaaacctggccaggctcccaggctcctnatctatgatgccctccaccgagggccacgtcggtactccccagcccccaggttcagtggcaaagtgggtctgggacagagttcactctcattatcagcagcctgctagtcagaagtatttagcttaggtttattactgtacagctagtataatgactgcctgtcgcaagggaccaaggtagaaattcgaaaagttacgtggtaggctgccactaagttcgtcg

SEQ ID NO: 439459 - DNA, 550 bp, Homo sapiens
  misc_feature: GZ8MTXP01D4G87.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaacttagcctggtaccagcagaaacctggccaggctcccaggctcctcatctatgatcgcctccaccgagggccactggtactcccagcccccaggttcagtggcaaagtgggtctgggacagacgttcactctcattatcagcagcctgcagtctgaagtatttagctaggtttattacgtgtcagtcagttataaatgtaacgtggccttaacggttcgggaacccaaagggggtaccaaagggtaggaaaacttacgaaaacgaacgtggtaggcctaggccttaacctaagttccgtaag

SEQ ID NO: 439460 - DNA, 514 bp, Homo sapiens
  misc_feature: GZ8MTXP01EP2O0.39.40.D07.1.454.CMB.2.raw
  modified_base (206)..(206): a, c, t, g, unknown or other
  modified_base (215)..(215): a, c, t, g, unknown or other
  modified_base (290)..(290): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctntcctgcagggccagtcagagtgttagcagcaacttagcctggtaccagcaagaacctggccaggctccagctccnatctatgatcgcctcaccagggccactggtactcccagccccaggttcagtggacaaagtgggtctggggacaggagttcactctacattatcagcagcctgcagtctagagtatttagctaggtttattacgtgtacagcagtataatgactggctcggtcgcttaagggaccaaggtgaaacttcgaaacgttactggtcggctgcttacctaattcgttcg

SEQ ID NO: 439461 - DNA, 530 bp, Homo sapiens
  misc_feature: GZ8MTXP01CZBHU.39.40.D07.1.454.CMB.2.raw
  modified_base (207)..(207): a, c, t, g, unknown or other
  modified_base (406)..(406): a, c, t, g, unknown or other
  modified_base (516)..(516): a, c, t, g, unknown or other
  modified_base (525)..(525): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaanagtcacctctcctgcagggccagtcagagtgttagcagcaaacttagcctggtaccagcagaaacctggccaggctcccaggctcctcatctaatgactcgccctccaaccgaggggcccacgtcggtaactccccaggcccccagggttcaggtggcaaaagttggggtctggggacaggacgttcactctcatttancagcagccctgcagtctagaagtatttagcttaaggtttacttactgtacagcaagtataactgtactggctacgtcggacaagggacaaggtgaaattcgaaagactgngctgcactnttctg

SEQ ID NO: 439462 - DNA, 505 bp, Homo sapiens
  misc_feature: GZ8MTXP01DE6D0.39.40.D07.1.454.CMB.2.raw
  modified_base (206)..(206): a, c, t, g, unknown or other
  modified_base (291)..(291): a, c, t, g, unknown or other
  modified_base (485)..(485): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcacctctcctgcagggccagtcagagtgttagcagcaacttagcctggtaccagcagaaacctggccaggctcccaggctctnatctatgatgcctccaccagggccagtggtactcccagccccaggttcaggtgcaaagtgggtccgggacagtagttcactctcattatcagcagcctgacagtctgaagtatttagctagtttatactgtacagcagtataatgactggcctaggttcgaaccaagggaccaaggttgaaatcaaaacggacngtggctggcacatcttgttc

SEQ ID NO: 439463 - DNA, 558 bp, Homo sapiens
  misc_feature: GZ8MTXP01AF3XT.39.40.D07.1.454.CMB.2.raw
  modified_base (206)..(206): a, c, t, g, unknown or other
  modified_base (216)..(216): a, c, t, g, unknown or other
  modified_base (235)..(235): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctntcctgcagggccagtcagngtgtagcagcaacttagcctggtaccagcagaaacctggaccaggcctcccaggcctcctcatctatgatcgccctccaccgagggccactggtactcccgagccccaggttcagtcgacaaagttgggtctggggacagtacgttcactctcaccatcagcagcctgcagtctagagtatttgcttaggtttattactgtacaactagtacaagtgacgtcggtaccttctcgtaacgtttcggggacgggtacgggaccgtaaagggtcggagttacgttaccgaaacggtaactgggtacggcgttacgcgaaccgtaag

SEQ ID NO: 439464 - DNA, 519 bp, Homo sapiens
  misc_feature: GZ8MTXP01E1A8T.39.40.D07.1.454.CMB.2.raw
  modified_base (206)..(206): a, c, t, g, unknown or other
  modified_base (295)..(295): a, c, t, g, unknown or other
  modified_base (323)..(323): a, c, t, g, unknown or other
  modified_base (336)..(336): a, c, t, g, unknown or other
  modified_base (373)..(373): a, c, t, g, unknown or other
  modified_base (382)..(382): a, c, t, g, unknown or other
  modified_base (388)..(388): a, c, t, g, unknown or other
  modified_base (417)..(417): a, c, t, g, unknown or other
  modified_base (486)..(486): a, c, t, g, unknown or other
  modified_base (505)..(505): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaaacttagcctggtaccagcagaaacctggccaggctcccaggctcctnatctatgatgcctcaccaggccatgtanccagccccaggtnagtgcaaatgggctgggacaggattcactctcaccancgagcagcngcagtnagtagtagttagttagtttagtttctgtnagataagtaataaataactcgtctctcgtcgtggtacgttcggacgaaacggaaacgtaaagaagaaanaacgaaacaacgtaagtgngacgtcgaacgtaa

SEQ ID NO: 439465 - DNA, 545 bp, Homo sapiens
  misc_feature: GZ8MTXP01AS7M8.39.40.D07.1.454.CMB.2.raw
  modified_base (206)..(206): a, c, t, g, unknown or other
  modified_base (235)..(235): a, c, t, g, unknown or other
  modified_base (295)..(295): a, c, t, g, unknown or other
  modified_base (405)..(405): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagngtgttagcagcaaacttagcctggtaccagcaagaaacctggccaggctccaggctcctnatctatgatcgccctccacccgaggggcccactcggtactccccgagccccctagggttcaaggtggacaaaggttgggtcgtggggaacaggtagttcactctcattancagcagccctgctaggtctagaagtatttagcttagggtttattacgtgtacagctagtataatgtactgctcggtcgaccgaagggaccaggtagaaattcgaaacgacgtgtacgggctggccacctaagttcgttcg

SEQ ID NO: 439466 - DNA, 539 bp, Homo sapiens
  misc_feature: GZ8MTXP01A6DFR.39.40.D07.1.454.CMB.2.raw
  modified_base (206)..(206): a, c, t, g, unknown or other
  modified_base (291)..(291): a, c, t, g, unknown or other
  modified_base (521)..(521): a, c, t, g, unknown or other
  modified_base (532)..(532): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgtagcagcaacttgcctggtaccagcagaaacctggccaggctcccaggctcctnatctatgatcgccctccaccgagggccagtcggtactcccgagcccccaggttcaggtcgcaaagttgggctgggacagtagttcactctcattatcagcagcctgcagtcagaagtatttagacttaggtttattactgtacagctaagtataatcgtaactcggaccttacggtcggaccgaaaggggaccttaagggtacgaaattacgaaacgttacgtgtacggntcgacaccgtnttccgtg

SEQ ID NO: 439467 - DNA, 628 bp, Homo sapiens
  misc_feature: GZ8MTXP01DWCRK.39.40.D07.1.454.CMB.2.raw
  modified_base (205)..(205): a, c, t, g, unknown or other
  modified_base (387)..(387): a, c, t, g, unknown or other
  modified_base (419)..(419): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaaanagtcaccctctcctgcgagggccagtcagagtgttagcagcaacttagcctaggtaccagcaagaacctggccaggcctcccgaggcctcctcatctatgactcgccctaccacccgacgggcctacgtcggtaactccccgagtcccccgtaggttcaggtcggacgtaaagtggggtcgnggggaaccagtacgttccacttctactattancagcagtcctgactagtcgtagaaagtatttagacttaggttttactacgtgtacgagtactaagttaactaaagtcggtaacgttcgggtacccgtttaacgggttaaccgggaaaccggttaaacggggtaaacccttaaaggggttaacgaaaacgttaccgaaaacgttacgtggtacgcgtcgaccttacctaagttccgttcg

SEQ ID NO: 439468 - DNA, 540 bp, Homo sapiens
  misc_feature: GZ8MTXP01DMAXB.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcacctctcctgcagggccagtcagagtgttagcagcaacttagcctggtaccagcagaaacctggccaggctcccaggctcctcatctatgatgcctccacagggccagtggtactcccagccccaggttcagtggcaaagtgggtctggggacaggagttcactctcaccatcagcagcctgcagtcgtagaagtattttgctaggttttattactgtacaaacagtacaattgactggacctctctaacgtttcggcgggtaacgggaccgtaaagggtggaacgttattacgaaacgaacgttggtacggcttacggtccgaaccgtaa

SEQ ID NO: 439469 - DNA, 635 bp, Homo sapiens
  misc_feature: GZ8MTXP01D9NVF.39.40.D07.1.454.CMB.2.raw
  modified_base (206)..(206): a, c, t, g, unknown or other
  modified_base (294)..(294): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagctaacttgcctggtaccagcaagaaacctggccaggcctcccaggctccncatctatgatcgccctccaccgagggccacgtggtactcccgagccccgtaggttcaggtcggactaaaagttcggggtcgtggggaactaggtacgttccacgtctactattatcagcagcccttagcctagtctagaacgttatttaagcttaagggttttattaccgttgtacgagtactagttaataacgttcgtaccgttacgggtcccttaacgggttccgggaaccgaaagggggtaacccttaaagggggttaacggaaaaacttaccggttaaaacgttaccggttggtacgggtccttacggacccttaaccgtaacgttcgtttaacccg

SEQ ID NO: 439470 - DNA, 572 bp, Homo sapiens
  misc_feature: GZ8MTXP01AW6L2.39.40.D07.1.454.CMB.2.raw
  modified_base (205)..(205): a, c, t, g, unknown or other
  modified_base (291)..(291): a, c, t, g, unknown or other
  modified_base (384)..(384): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgtagcagcaacttagcctggtaccagcagaaacctggccaggctcccaggctccncatctatgatcgcctccaccagggccactggtactcccagccccaggttcagtggcaaagtgggtctggggacagagttcactctcatttacncagcacgcctgactagtctagaagtattagcttaaggtttattacgtgtacagtacgtaagttaataagtcgtaccgttcggtacccgttacgggtaaccgggaaccggaaacggggtaaccgaaagggtaacggtaaacttacggaaaacgttacgtggtcggtctcgaccttactaacgttcgtcg

SEQ ID NO: 439471 - DNA, 572 bp, Homo sapiens
  misc_feature: GZ8MTXP01D24QD.39.40.D07.1.454.CMB.2.raw
  modified_base (206)..(206): a, c, t, g, unknown or other
  modified_base (293)..(293): a, c, t, g, unknown or other
  modified_base (383)..(383): a, c, t, g, unknown or other
tcagtcgcactagtcacgaccggtgctcgatttagtgatagagcgtaacaacagagggggaggaactgctcagttgggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagcaaacttagcctggtaccagcagaaacctggccaggctccgagctcctnatctatgatcgcctccaccgaggccagtcggtatcccagccccaggttcagtgcaaagtgggtctgggacagacgttcactctctattancagcagctagctagtctagaatatttagcttaaggttttatacgtgtacagtactagttaactaagtcgtaactggacccttaggttaacggcccgaaaggggaacccgttaaagggttaaaggaaaacttaccgaaaacggttaacgtgggttacgaaccgttaggacttaaccctaattcgttaacg

SEQ ID NO: 439472 - DNA, 577 bp, Homo sapiens
  misc_feature: GZ8MTXP01BYA9H.39.40.D07.1.454.CMB.2.raw
  modified_base (206)..(206): a, c, t, g, unknown or other
  modified_base (399)..(399): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagcaacttagcctggtaccagcagaaacctggccaggctccaggcctcctcatctatgactcgccctccgaccgacgggccacgtcggtaactccccgagcccccaggttcaggtggctaaagtgggtctggggacaggtacgttcactctcattancagcagcctagctagtctagaagtatttagcttaggtttacttacgtgtcaagtcagttaataagtgtacgttacggccttacggtccggaccgttaaaggggtaccaaagggttacggaaaacttaccggaaaacgttacgtgtcgggaactcggaccttacctaagttcgttaacg

SEQ ID NO: 439473 - DNA, 571 bp, Homo sapiens
  misc_feature: GZ8MTXP01BH3Q9.39.40.D07.1.454.CMB.2.raw
  modified_base (207)..(207): a, c, t, g, unknown or other
  modified_base (236)..(236): a, c, t, g, unknown or other
  modified_base (295)..(295): a, c, t, g, unknown or other
  modified_base (306)..(306): a, c, t, g, unknown or other
  modified_base (316)..(316): a, c, t, g, unknown or other
  modified_base (329)..(329): a, c, t, g, unknown or other
  modified_base (381)..(381): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaangtccaccctctcctgcagggccagtcagngtgtagcagcaacttgcctggtaccagcaagaaacctggccagacctcccaggctcctnatgtatggtcncgtccaccgngggccagtgtacnccgagcctaggttcagtgcaggtgggctgggacagtacgttcagtctcaccntcagcacgtcctgactagttctagtaagttatttagtacttttatacgtgtacagtactaagtatcgtataccgtggtacccttcaccgttcgtttcgggccgaagggggtaccttaggggttacggaagttaaccgttcgaaaaacggtaacgttgggtcggtctacggaccctaaccttaagtttccg

SEQ ID NO: 439474 - DNA, 580 bp, Homo sapiens
  misc_feature: GZ8MTXP01ED50D.39.40.D07.1.454.CMB.2.raw
  modified_base (206)..(206): a, c, t, g, unknown or other
  modified_base (397)..(397): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccatggaagaaatagtgatgacgcagtctccagccaccctgtctgtgtctcgaaggggaaangtccaccctctcctgcagggccagtcagagtgttagcagctaacttgcctggtaccagcagaaacctggccaggcctccaggctcctcatctatgactcgccctaccgacccagggccacgttggtactcccagcccaggttcagtggactaaagtgggtctggggacaggtacgttcactctacatttancagcagcctgactagtcagaaatatttagcttaagggttttaatacgtgtcaagtctaagttaataaagtgtaaccgttgggtacccttacgggttccgggaacgaaaggggaaccttaaaggggtacgaaaacttacggaaaacggttacgtggtgggtctcggaccactaagttcttaacg

SEQ ID NO: 439475 - DNA, 805 bp, Homo sapiens
  misc_feature: GZ8MTXP01EW9ZZ.39.40.D07.1.454.CMB.2.raw
  modified_base (207)..(207): a, c, t, g, unknown or other
  modified_base (273)..(273): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagataccactggagaaatagtgatgtcgcagtctccagcccaccctgtctgtgtctccgaggggaaancgccacctctcctgcagggccagtcagaatattagcaccaattagcctaggtaccaacagaaaccnggaccagggtcccagactcctcatctatgatgaactccgaaccgacggggtaccctaccgttacgggttttccccacggtaccctacggggtttaccgtacggttcgggaccggtaggggttcgggggtccgttacggggggaaacccaaagggttaacgggttttaccgtaaaccctttccgttacccgaaaccctaaacgtccgtaaacggccgaacggtcccttacgggcctaaggttccgttaaggtaaagttacgtttttcgaccgttaagtttttaacgtttactacggttacgtaacgttaactaaagtttaaagtaacggtttaaaccgtgggggtttacgggtaaacccgggtttccgggtaaccggaaaccggggtaaacccgttaaaagggggttaaggtaaaaacgttaaaccgaaaaaccggttaaacggttggtaaccgggggttacttcgggacccttaaccccggagttttccttcggtacctttacccgtaacgtttcccccgtttaaccccggg

SEQ ID NO: 439476 - DNA, 671 bp, Homo sapiens
  misc_feature: GZ8MTXP01BIWU2.39.40.D07.1.454.CMB.2.raw
  modified_base (206)..(206): a, c, t, g, unknown or other
  modified_base (300)..(300): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaangtccaccctctcctgcagggccagtcagagtgtagcagctaacttagcctaggtaccagacaagaaacctggaccaggcctcccgaggcctccntatctatgatcgccctccgaccgacgggcctacgtcggtactccccgaggtcccctagggttcaggtcggaccaaaagttcgggggtctgggggaaactagggtacgtttccacttcttactaatttacgccgaaggctacggtcctaggacctaggttaccaggtaaagttagttttaagccttaaaggggtttttaacttacgttagtactagtactaagttaactaaagtcgtaacgttcggtacccgttacgggtaaccgggaacgttaaacgggggtaaccgttaaaggggttaaaggaaaacgttaccgaaaaacggttacgtttaagggacgggtcttacggaccttaccctaagttccgttcg

SEQ ID NO: 439477 - DNA, 670 bp, Homo sapiens
  misc_feature: GZ8MTXP01BATLT.39.40.D07.1.454.CMB.2.raw
  modified_base (207)..(207): a, c, t, g, unknown or other
  modified_base (298)..(298): a, c, t, g, unknown or other
  modified_base (424)..(424): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaangtccaccctctcctgcagggccagtcagagtgtagcagctaacttagcctggtaccagcaagaaacctggaccaggcctcccaggcctccncatctatgatcgccctccaccgagggccacgtggtacctccccgacggcccctaggttacgaggtcggactaaaggttcggggtcgtaggggaacctagggtacgtttccacttcgtactatttanacacgcacgtctaggcctagtctaggaaagttagtttaggtacttaaggggtttttattacgtagttacagtcgtaagttaataaacgtgtaaccgttcggtacccttaacgggttccggaaaccggaaacggggtaacccgaaaagggggttaaaccggtaaaaacgttacccgaaaaacgggttaccgttaagggtacgggtaaccttacgggaaccgttaaccctaacgtttccgttaaccgg

SEQ ID NO: 439478 - DNA, 675 bp, Homo sapiens
  misc_feature: GZ8MTXP01CV3KL.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccacctctcctgcagggccagtcagagtgttagcagcaaacttagcctggtaccagcagaaacctggccagctcccaggctcctcatctatgatcgccctccacccgacgggccacgtcggtactccccgagtcccccgaggttcgaggtcggaccgtaaaggttcggggtcgtgggaaccaggtacgttcacgtctactatttatcgagcacggccctagacctagtcgtaggaaagttagtttaagtcttaaggggttttaactttaccgttagttaccgtaaaggtcctaaagttaagttaaacgtacgtaccggtttaccggtacccgtttaaccgggttaaccggaacccggttaaacgggggtaacccgttaaaaggggttaaacggaaaacgttaaaccgttaaaaccggttaaacgttgggttacggcgttaccggacttaccctaagttcctttaacg

SEQ ID NO: 439479 - DNA, 540 bp, Homo sapiens
  misc_feature: GZ8MTXP01A5VZH.39.40.D07.1.454.CMB.2.raw
  modified_base (205)..(205): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagataccactggagaaatagtgatgtcgcagtctccagccaccctgtctgtgtctcgaggggaaanagccaccctctcctgcagggccagtcagaatattagcacacttagcctggtaccaacagaaacctggccagggtcccagacctcctcatcatgatgaatccacaggccactcggttcccagccagttcagtcggcgaggtgggtcgtgggaacagtgttcacgtcctcaccatcacgcagcctgcagtctagatacttttgacttagtttattactgtcagtactaataagtagtaacgtgggtcgtacggttacggaccaaagggaccgaaaggtggaaacttagaaaccagttgagcgttcgacaaccatctgtcttctaacttccgttcccg

SEQ ID NO: 439480 - DNA, 677 bp, Homo sapiens
  misc_feature: GZ8MTXP01DJDRP.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaaggggaaanagtcaccctctcctgcagggccagtcagagtgttagcagcaaacttagcctggtaccagcagaaacctggccaggctccaggctcctcatctatgatcgcctcaccgaggccacgtggtactcccagcccccaggttcaggtcgactaaaagttcggggtcgtaggggaaccagggtaacgttccaacttcgtactaatttactcgaagccgtaagtcccttaggcctaagggttccttaggaaacgttattttaagccgttaaaggggttttttaaacttaccgtttaggtacctaaggtccttaaagttaacttaaagttgtaacccgttagggtacccgttaacgggtttaaccgggaacccgttaaagggggtaacccttaaaggggttaaacggtaaaacgttaccgttaaaacggttaaacgttgggtaacgtcgttaggaccttaaccgtaacgttcgtttccg

SEQ ID NO: 439481 - DNA, 531 bp, Homo sapiens
  misc_feature: GZ8MTXP01E4541.39.40.D07.1.454.CMB.2.raw
  modified_base (202)..(202): a, c, t, g, unknown or other
  modified_base (288)..(288): a, c, t, g, unknown or other
  modified_base (381)..(381): a, c, t, g, unknown or other
  modified_base (389)..(389): a, c, t, g, unknown or other
  modified_base (396)..(396): a, c, t, g, unknown or other
tcagtcgcactagtcacgaccggtgctcgatttagtgatagagcgtaacaacagaggggaggaactgctcagttaggacccagacggaaccatggaagccccagcgcagcttctcttcctcctgctactctggctcccagattccactggagaaatagtgatgacgcagtctccagccaccctgtctgtgtctcaggggaangtcacctctcctgcagggccagtcagagtgttagcagcaacttagcctggtaccagcagaacctggccaggcctcccaggctcctnattctatgatcgccctccaccgagggccaacgttggtaactccccgagccccctagggtttcaaggtggctaaaagttgggtctggggacagngttcactntcattancagcagccctgcctagtctagaagtattagctagggtttatactgtacagcagtatatgactcggcctacggtcgacgaagggaccaagggtacgaaacttcgaaacgacgtgcggctgaccactaacttcgtcg

SEQ ID NO: 439482 - DNA, 600 bp, Homo sapiens
  misc_feature: GZ8MTXP01DDGIO.39.40.D07.1.454.CMB.2.raw
  modified_base (206)..(206): a, c, t, g, unknown or other
  modified_base (290)..(290): a, c, t, g, unknown or other
  modified_base (380)..(380): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcacctctcctgcagggccagtcagagtgttagcagcaacttagcctggtaccagcagaacctggccaggctccaggctccnatctatgatgcctcaccagggccatggatcccagccccaggttcagtgcaaagtgggtctgggacaggtagttcacgttctacatttacncagcacgtcctgactagtcgtagtaagttatttacgactttaaggttttacttacgtgtacaagtactaagttaataaacgtcgtaccgttcgggtacccgttacgggttccggaaccggaaacggggtaaccgttaaaggggttaacggtaaaacttaaccggaaaacgttacgttgggtacggtaacgtacgaccttaccgtaacgtttccgttaacg

SEQ ID NO: 439483 - DNA, 607 bp, Homo sapiens
  misc_feature: GZ8MTXP01EEXDF.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcgagggccagtcagagtgttagcagctaaactgcctggtaccagacaagaaacctggccaggcctccgagcctcctcatctatgactcgcctccaccgagggccacgtcggtactcccagcccctaggttcaggtcgactaaagtgggtcgtggggaacaggtacgttccaactctactatttacgcacgctacgccttaggactagtctagaacgtatttagacttaagttttattactgttacaagtactaaggttataaagtcgtaaccgtcggtcccgttaacgggttcgggaaccgttaaaggggtaacccgttaaagggtaaggtaaacttaacgaaacgttacgtgcgggaacttcggacaccgtaactttcgttaacg

SEQ ID NO: 439484 - DNA, 603 bp, Homo sapiens
  misc_feature: GZ8MTXP01EABCP.39.40.D07.1.454.CMB.2.raw
  modified_base (206)..(206): a, c, t, g, unknown or other
  modified_base (411)..(411): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagagtgttagcagcaacttagcctggtaccagcagaaactggccaggctcccaggctcctcatctatgatgcctccaccgagggccacgtggtactcccgagccccaggttcagtggacaaagtgggtctgggacagtacgttcactctacattatcagcagctagcagtctagaagtntttgacttaggttttattacgtgtacaaactagtaactaagttacgtacgtcgggtacccttcttccggtaaccgttttccggggacggggtaaacggggttaaacccgtaaagggggttggaaacggttacttaaccgaaaaacggtaaccgttgggttacgggcttacggccgttaaaccccgtttaacg

SEQ ID NO: 439485 - DNA, 542 bp, Homo sapiens
  misc_feature: GZ8MTXP01C88Z0.39.40.D07.1.454.CMB.2.raw
  modified_base (206)..(206): a, c, t, g, unknown or other
  modified_base (289)..(289): a, c, t, g, unknown or other
  modified_base (296)..(296): a, c, t, g, unknown or other
  modified_base (383)..(383): a, c, t, g, unknown or other
  modified_base (532)..(532): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcacctctcctgcagggccagtcagagtgtagcagcaacttagcctggtaccagcagaaacctggccaggctccaggctcncatctangatgcctccaccgaggccagtggtactcccagccccctaggttcagtgcaaagtgggtctggggactaggagttcactctacattancagcagccagctagtctagaagtatttagcttaggtttattactgtacagctagtaataaatgtactggaccttacggttcggacgaaaggggaccaaagggtacgtaaaattaccgaaagaacgttggtacggctcggaccttacctnttaaccgttg

SEQ ID NO: 439486 - DNA, 632 bp, Homo sapiens
  misc_feature: GZ8MTXP01AV34X.39.40.D07.1.454.CMB.2.raw
  modified_base (208)..(208): a, c, t, g, unknown or other
  modified_base (448)..(448): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagcccaccctgtctgtgtctccgaaggggaaangtccaccctctcctgcagggccagtcagagtgttagcagcaattagcctggtaccagcaagaacctggccaggcctcccgaggtcctccctcatctaatgactcgcccctccaacccgacgggccctacgttcggtaactcccccgaagccccccgtaagggtttcgaaggttcggggacctaaaagggttcgggggtcctgggggaaccagggtacgtttccaacttctacaatttacncagccaggtcctagctagtctagaacgttgttagcttagtttactacgtgtacaggtctaaagttactaaagtcggtaactcggtcccgttaaggttcccgggaacgttaaaggggaaacccaaggggttacgaaaacttaccgaaacggacttgggacgtcgtgacccacgtaagttccttcg

SEQ ID NO: 439487 - DNA, 574 bp, Homo sapiens
  misc_feature: GZ8MTXP01C5OPZ.39.40.D07.1.454.CMB.2.raw
  modified_base (204)..(204): a, c, t, g, unknown or other
  modified_base (268)..(268): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaangtcacctctcctgcagggccagtcagagtgttagcagcaacttgcctggtaccagcagaaaccnggccaggctcccaggctcctcatctatgatgcctcaccaggccatggtactccagccccaggttcagtgcaaagtgggtctgggacaggagttcacttctctattatcagcaggccctagctagtcagaagtatttagacttaaggtttacttacttgtacagtcctaagtataacgtgtaacgtcggtaccgtacggttaaccgggaccgaaaggggacccgttaaagggtaaacggtaaacgttaaaccgaaacggttaaaccgttggtacggtcgttcgacgttacctaacttcgtttaaccg

SEQ ID NO: 439488 - DNA, 598 bp, Homo sapiens
  misc_feature: GZ8MTXP01AWW1Z.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgtagcagcaactgcctgtaccagcagaacctggccaggcctcccaggcctcctcatctatgatcgccctccacccagggccacgtcggtactcccagtccccaggttcagtggcaaagtcgggtcgtgggactaggtagttcacttctctattactcagcacgctagctagtcgtagaagtattagcttagggtttacttacgtgtaccgtagacgtagttaataaacgtcgtaacgttcgggtacccgttaaccgggttccgggaaccgttaaacgggggaaacccttaaggggttaaacgaaaacgttaccgaaaacgttacgttggacgggtctcggaccttaccgtaagttccttcg

SEQ ID NO: 439489 - DNA, 608 bp, Homo sapiens
  misc_feature: GZ8MTXP01D7TT9.39.40.D07.1.454.CMB.2.raw
  modified_base (206)..(206): a, c, t, g, unknown or other
  modified_base (328)..(328): a, c, t, g, unknown or other
  modified_base (396)..(396): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccacctctcctgcagggccagtcagagtgtagcagcaacttgcctggtaccagcagaaacctggccaggctcccaggcctcctcatctatgatgccctccaccgagggccacgtggtacncccgagccccaggttcagtggacaaagttgggtctgggaaccaggtacgttcacttctactatttacncgagcacgtctgctagtcgagtaaagttatttaagtctttaagggttttaacttacgttgtacgtagtacgtaagttaataagttcgtaccgttggtacccttaacggtccggaaccgaaacggggtaaccgttaaaggggtaacgtaaaacgttaccgaaaacggttacgttgggtacggtaacctacgaccttacctaacgttcgtaacg

SEQ ID NO: 439490 - DNA, 506 bp, Homo sapiens
  misc_feature: GZ8MTXP01ARPJ8.39.40.D07.1.454.CMB.2.raw
  modified_base (205)..(205): a, c, t, g, unknown or other
  modified_base (292)..(292): a, c, t, g, unknown or other
  modified_base (492)..(492): a, c, t, g, unknown or other
  modified_base (495)..(495): a, c, t, g, unknown or other
  modified_base (501)..(501): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgtagcagcaacttagcctggtaccagcagaaacctggccaggcctcccaggctcctnatctatgatcgccctccaccagggcccacgtcggtactccccgagcccccaggttcaggtggcaaagtgggtctggggacagacgttcactctcattatcagcagcctgctagtctagaagtatttagctaggtttatacgtgtcagctagtataatgacgtggcctagtcgacgagggacaggtagaattcgaagctgngcngcactnttctg

SEQ ID NO: 439491 - DNA, 593 bp, Homo sapiens
  misc_feature: GZ8MTXP01CWZS9.39.40.D07.1.454.CMB.2.raw
  modified_base (205)..(205): a, c, t, g, unknown or other
  modified_base (289)..(289): a, c, t, g, unknown or other
  modified_base (470)..(470): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaanagtccaccctctcctgcagggccagtcagagtgttagcagcaacttagcctggtaccagcagaacctggccaggctcagctctnatctatgatcgcctccaccaggccacgtggtactcccagccccctagggttcaggtcggactaaaggttcggggtctggggaactaggtacgttccactctactattagtcagcagtcctgctagtctagaagtatttagtacttaggtttattacttgtacgagtacagtataaggggtntacgtcggtaccgtacggttccggaaccggaaacgggtaccgaaacgggtaacggtaaacgttaccgaaaacggttaaccgttggtacgggtcgtacggaccaacccgtaacgttcgttaacg

SEQ ID NO: 439492 - DNA, 551 bp, Homo sapiens
  misc_feature: GZ8MTXP01A5H1D.39.40.D07.1.454.CMB.2.raw
  modified_base (206)..(206): a, c, t, g, unknown or other
  modified_base (235)..(235): a, c, t, g, unknown or other
  modified_base (294)..(294): a, c, t, g, unknown or other
  modified_base (401)..(401): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagngtgtagcagctaacttgcctggtaccagcagaaacctggccaggcctcccaggctcctnatctatgatcgccctccaccgtacgggccacgtggtactcccgagcccccgtaggttcaggtgacaaagttggggtctggggacagtacgttcactctactatttancagcacgcctagctagtctagaagtatttagacttaggttttactacgttgtacagctagtataagtgtactggtcctaggtcggacgaagggaccaaggtaggaaacttacgaaacgttactaaggcggtctcgcacctaattcgttcg

SEQ ID NO: 439493 - DNA, 547 bp, Homo sapiens
  misc_feature: GZ8MTXP01AGVUS.39.40.D07.1.454.CMB.2.raw
  modified_base (205)..(205): a, c, t, g, unknown or other
  modified_base (385)..(385): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgttagcagcaacttagcctggtaccagcagaaacctggccaggctccccaggctcctcatctatgatgccctcaccagggccactggtactcccagccccaggttcagtggcaaagtgggtctggggacagagttccactctactattancagcagcctgactagtctagaagtatttagactaggtttatactgtcagtcagttataagtgtacgtcggtcctacggttccggacgaaacggggacccaaggggttacggaaacttccgaaaacgttactgggtcggaactcggccacctaagttcgttcg

SEQ ID NO: 439494 - DNA, 553 bp, Homo sapiens
  misc_feature: GZ8MTXP01EJPWR.39.40.D07.1.454.CMB.2.raw
  modified_base (302)..(302): a, c, t, g, unknown or other
  modified_base (346)..(346): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccaccctctcctgtagggccagtcagagtgttagcagcaacttagcctggtaccagcagaacctggccaggtcccaggctcatcatctatggtncactcccaacgagggccacgtggtactcccagccctactttagnggcaagggtgggtctggggacaggtagttcactctacacatcagcagcctgctagtctagaagttatttgacttaggtttattactgtacaactagtaacaagtgtacgtgtcccttctccgtaacgtttcgggacgggtacgggaaccgtaagggtcggaagttacttacgaaacggtactggtacggcttacggccaacgtaacg

SEQ ID NO: 439495 - DNA, 650 bp, Homo sapiens
  misc_feature: GZ8MTXP01DVRS3.39.40.D07.1.454.CMB.2.raw
  modified_base (205)..(205): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaangtccaccctctcctgcagggccagtcagtagtgttagcagcaattgcctggtaccagcagaacctggccaaggcctcccaggcctcctcatctatgactcgccctaccacccgaggggccccacgttcggtacctccccgacgtcccccgagggtttacagggtcggtaccgaaaagttcggggtccgtgggggaaaccctaggacgtttcaactctactattagtcagcacgcttagctagtcgtagaaacgtatttacgcgtttaggtttactttacgtgtaccgagtctaaggttataaattcggtaacgtcgggtacccttaggggttaacccggaccgaaacggggtaacccttaaaggggtaaccgtaaaagttaccgttaaaacggttaaccgtggggtaagggtcccttacggaccaaacccgtttcgttccgttcg

SEQ ID NO: 439496 - DNA, 653 bp, Homo sapiens
  misc_feature: GZ8MTXP01BLJC2.39.40.D07.1.454.CMB.2.raw
  modified_base (207)..(207): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaangtcaccctctctgcagggccagtcagagtgtagcagcaactagcctggaccagcagaacctggccaggctccgaggctcctcatctatgactcgcctccgaccgacgggcctacgtcggtaactccccgagtccccgtagggttcaggtcggactaaagttcggggtctaggggaactaggtacgttcaccttctactattactacgacggtcaacggtcccttaggactagtcgtagtaaagtatttaagacttaaaggggttttattaccgttagtactaaggtcctaaagttaattaaacgtcgtaacgtcggtaccccttaacggggttccggaaccggaaaggggtaacccgttaaaggggtaacggtaaacttaaccggttaaaacggttacgttcggtacggtccgttaggaccccttaacgttaacttcgtttaaccg

SEQ ID NO: 439497 - DNA, 583 bp, Homo sapiens
  misc_feature: GZ8MTXP01AOIWM.39.40.D07.1.454.CMB.2.raw
  modified_base (206)..(206): a, c, t, g, unknown or other
  modified_base (234)..(234): a, c, t, g, unknown or other
  modified_base (294)..(294): a, c, t, g, unknown or other
  modified_base (300)..(300): a, c, t, g, unknown or other
  modified_base (406)..(406): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagngtgttagcagcaacttgcctggtaccagcaagaaacctggccaggcctcccaggctcctnatctangatcgccctccaccgagggcccagtcggtactccccgagcccctaggttcaggtcggactaaaaggtgggtcgtggggactaggtacgttcacttctactatttancgagcacgtcctggctagtcgtagaagtatttacgacttagggtttattaccgtgttacgagtctagtaattaagtcgtacgtcggtccttacggtcggaacccgaagggtaaccaagggttaacggaaacttaccgaaacggttacgtggcggtcacggaccacctgttccgtaac

SEQ ID NO: 439498 - DNA, 592 bp, Homo sapiens
  misc_feature: GZ8MTXP01AJSZT.39.40.D07.1.454.CMB.2.raw
  modified_base (207)..(207): a, c, t, g, unknown or other
  modified_base (294)..(294): a, c, t, g, unknown or other
  modified_base (417)..(417): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaanagtccaccctctcctgcagggccagtcagagtgtagcagcaattgcctggtaccagcaagaacctggccaggcctcccaggcctccncatctatgatcgccctccgaccgagggcccacgttcggtactccccgagtccccgaggttcagggtcgacgtaaagttggggtctaggggaactaggtacgttccaacgttctactatttacncaagtccagtcccgtgacctagtctaggaattatttagcttaagggttttaacttcgtgttacagtacgtaagtattaagcgtacgtcggtaccgtacggtccggaacgaaggggtaccaaggggttaagaaacttaccgaaagttacgtggtcgcgtacgacactaagttctcg

SEQ ID NO: 439499 - DNA, 607 bp, Homo sapiens
  misc_feature: GZ8MTXP01DRAFN.39.40.D07.1.454.CMB.2.raw
  modified_base (205)..(205): a, c, t, g, unknown or other
  modified_base (294)..(294): a, c, t, g, unknown or other
  modified_base (328)..(328): a, c, t, g, unknown or other
  modified_base (418)..(418): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaaangtccacctctcctgcagggccagtcagagtgttagcagctaaacttagcctggtaccagcagaaacctggccaggcctccaggctcctnatctatgatgcctccaccgagggccacgtgtacnccagccccaggttcagtgcaaagtgggtctggggacaggtacgttcacgttctactattatcagcagtccctggactagtctagaaagtntttacgacttaggttttaatcgttgtacagtactagtaataaagtcgtacgttcggtaccttaacggttccgggacgaaacgggggtaaccgttaaagggttaaacgggaaaacttaaccggaaaaccggttaaagttcggggtaacggccgttagggacccgttaacctaacgtttccgtttaaccgg

SEQ ID NO: 439500 - DNA, 718 bp, Homo sapiens
  misc_feature: GZ8MTXP01BU5A4.39.40.D07.1.454.CMB.2.raw
  modified_base (207)..(207): a, c, t, g, unknown or other
  modified_base (282)..(282): a, c, t, g, unknown or other
  modified_base (294)..(294): a, c, t, g, unknown or other
  modified_base (428)..(428): a, c, t, g, unknown or other
  modified_base (707)..(707): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaancgtccaccctctcctgcagggccagtcagtgtgtagcagctaactagcctggtacagcagaacctggccaggccnccgaggtctccnatctatgatcgccctccacgcggcctacgtcgtactcccgagtacccccgtaggttcgaggttcggacgtaaaagggttcgggttcgtacgggggaaactacgggttaccgtttccacgttctactaatttacncgaacggcctacgggtcccttaaggccttaaggtttcctaaggtaaacgtttagttttaacgtaccgttttaaggggtttttaactttacggtacgttaacgtaaccggtataaaggtttaattaaaggtttccgaaacgggtttccggttaacccggttaaccgggttaaccgggaaaccgggttaaacgggggtaaacccgtttaaagggggaaacgtaaaaccgttaaccggaaacggttaaccgtggggttacgaaccgtcgaccttaccggttntttcccgtttg

SEQ ID NO: 439501 - DNA, 593 bp, Homo sapiens
  misc_feature: GZ8MTXP01BCIEW.39.40.D07.1.454.CMB.2.raw
  modified_base (207)..(207): a, c, t, g, unknown or other
  modified_base (293)..(293): a, c, t, g, unknown or other
  modified_base (417)..(417): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagcccaccctgtctgtgtctccgaaggggaanagtcaccctctcctgcagggccagtcagagtgtagcagcaacttagcctggtacagcaagaactggccaggcctcccaggcctccncatctatgatcgccctaccgacccgagggcctacgttcggtactccccgagtccccgtacggttcaggtcggacctaaagttcggggtcgtaggggacctaggtacgttcacttctactattancagcacgtctgactgtctagaagtattagtactaggtttatagtgtcagtctagtataagtgtacgtcggtccgtacggttccgaacggttaaacgggaaccgttaaaggtacggaaacttaccgttaaaggaaccgttggtcggtaacgtcgaccttaccgtaacttcgttaacg

SEQ ID NO: 439502 - DNA, 687 bp, Homo sapiens
  misc_feature: GZ8MTXP01CHONW.39.40.D07.1.454.CMB.2.raw
  modified_base (191)..(191): a, c, t, g, unknown or other
  modified_base (207)..(207): a, c, t, g, unknown or other
  modified_base (243)..(243): a, c, t, g, unknown or other
  modified_base (291)..(291): a, c, t, g, unknown or other
  modified_base (297)..(298): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagcccacctgtctgtntctccgaaggggaaangtccaccctctcctgcagggccagtcagagtgtagnagctaaacttgctggtaccagcaagaactggccaggctccagctcctnatctannactcgcctaccgaccgtagggccacgtcggtacctcccgacgtacccccgtagggttacaggtcgaccgtaaaggtcggggtcctaggggacagggttacttccaacttctacgtaacttagtaccaaggccctacgtccgttcggaccttacggtaccttagggtaaacttaagttacgtaccgtttaagggttttaacctagtttacgacgtaagtacctaaagggtaacttaaagtcgtaaacggttcggtacccgttaacggggttccggaaccgttaaaccgggggtaacttaaaggggtaaacggtaacgttaaaccggaaaaccttaggttcggggtaacctcggttaccgaacggttaaccctcggtttccctttaaccgg

SEQ ID NO: 439503 - DNA, 732 bp, Homo sapiens
  misc_feature: GZ8MTXP01CRJ02.39.40.D07.1.454.CMB.2.raw
  modified_base (206)..(206): a, c, t, g, unknown or other
  modified_base (334)..(334): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccacctctcctgcagggccagtcagagtgtagcagcaacttagcctggtaccagacaacgaaccgtgccaggcctcccgaggctcctcatctagtgatcgccctccaccgaggcctacgtggtacncccgacgccccgtaggtcaggttcggacgaaagggttcggggtcgtacggggtaacgaggttacggttaccacttactacttaattttaacaccgaacggtccctaaggccccgttaggtaccgttaaggtaccggttaagtaaacgtttaagttttacggtaaccttttaaggggtttttaacttaacggttcggtaacccgtaagtaccgttaaaggttaactttaaacgtcggttaacccgtaccggggttaaccctttacccgggggtttaacccggggaacccggaaacggggttaaacccggaaaagggttaaggtaaaacccttaaaccggaaaacggttacgtaagggtaccggtcgtaccgaccttaccggttaactttcgtttaaccg

SEQ ID NO: 439504 - DNA, 699 bp, Homo sapiens
  misc_feature: GZ8MTXP01AVTON.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaancgtccaccctctcctgcagggccagtcagagtgtagcagacaactgcctggaccagcaacgaacctggccaggcctcccgaggtcctcctcatctatcgactcgccctccgaccgacggcctacgtcggtactcccgagtccccgtaggttcgaggtcggactaaacggttcggggtcgtaggggaactaggtacgtttaccacgttactactaatttagtaccgaggtaccacggtccttacggaccgtaaacggttgtaaacgggtaaagtttagtttaacggtaccgtttaaggttttaaacgtttacgttacggtacctaaggtaccgtaaggttaaacttaaggtacgtaaccggttcggtaacccgtttacggggttccgggaaaccgaaacggggtaaccgaaagggttaagggaaaaccgttacgaaaaccgggttacgttcgggacgaaccgttacgaccgttacttaacgtttcggttaaccg

SEQ ID NO: 439505 - DNA, 624 bp, Homo sapiens
  misc_feature: GZ8MTXP02HS15F.39.40.D07.1.454.CMB.2.raw
  modified_base (205)..(205): a, c, t, g, unknown or other
  modified_base (213)..(213): a, c, t, g, unknown or other
  modified_base (292)..(292): a, c, t, g, unknown or other
  modified_base (398)..(398): a, c, t, g, unknown or other
  modified_base (403)..(403): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccacctgtctgtgtctccgaggggaaangtcacctntcctgcagggccagtcagagtgttagcagcaacttagcctggtaccagcaagaaacctggccaggctcccaggcctctnatctatgatcgcctccaccgagggcccacgtggtactccccagccccagggttccaggtcggactaagtggggtctggggacaggtacgtttcactctcatttacncagcngtcctgactagtcagtaagttatttagatttaagttttacttacgtgtacgagtactaagttaataagtcggtacgtacggtaccgttaacgggttaccgggaaaccggtaaaacggggtaaaccgtaaaggggttaaacggtaaaaaccgttaaaccgaaaacggtaacggtaacgggtacggaaccgttacgaacccgtaaccgtacgtttaccgtacg

SEQ ID NO: 439506 - DNA, 519 bp, Homo sapiens
  misc_feature: GZ8MTXP02ILD80.39.40.D07.1.454.CMB.2.raw
  modified_base (205)..(205): a, c, t, g, unknown or other
  modified_base (291)..(291): a, c, t, g, unknown or other
  modified_base (383)..(383): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctccagattccactggagaaatagtgatgacgcagtctccagccaccctgtctgtgtctccgaggggaaangtcaccctctcctgcagggccagtcagagtgtagcagcaacttagcctggtaccagcaagaaacctggccaggctcccaggctccncatctatgatcgccctccaccgaggccactggactcccagccccaggttcagtggcaagtgggtctggggacaggtagttcactctcattancagcagcctgcagtctagagtatttagctaagtttattactgtacagactagtataatgactcggactacgttcggactaagggaccaaggtacgaaactacgaaagtacgtggtcgactacgacacctagtctag

SEQ ID NO: 439507 - DNA, 524 bp, Homo sapiens
  misc_feature: GZ8MTXP02IMRLL.39.40.D07.1.454.CMB.2.raw
  modified_base (204)..(204): a, c, t, g, unknown or other
  modified_base (383)..(383): a, c, t, g, unknown or other
  modified_base (406)..(406): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaangtcaccctctcctgcagggccagtcagagtgttagcagcaacttagcctggtaccagcagaaacctggccaggcctccaggcctcctcatctatgatgcctccaccagggccactggtactcccagccccaggttcagtggcaagtgggtctggggacaggtagttccactctcattancagcagcctgcagtctagaagtntttagcttagtttattactgtcagcagtatatgactgctacgttcggactaaggggaccaaagggtacggaaactacgaaaacgtaacgtggtacggactacgactacctattctacg

SEQ ID NO: 439508 - DNA, 510 bp, Homo sapiens
  misc_feature: GZ8MTXP02GC66C.39.40.D07.1.454.CMB.2.raw
  modified_base (205)..(205): a, c, t, g, unknown or other
  modified_base (214)..(214): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctntcctgcagggccagtcagagtgttagcagcaacttagcctggtaccagcagaaacctggccaggctccaggctcctcatctatgatgcctcaccagggccactggtatcccagccccaggttcagtggcaagtgggtctggggacaggtagttcactctcattatcagcagccctgcagtctgaagtatttagctagtttatactgtacagcagtatatgactggcctacggtcggacaagggacctaaggtacggaaactacgaaacgaactgtacggctcgacacctatctacg

SEQ ID NO: 439509 - DNA, 522 bp, Homo sapiens
  misc_feature: GZ8MTXP02JI8FA.39.40.D07.1.454.CMB.2.raw
  modified_base (205)..(205): a, c, t, g, unknown or other
  modified_base (273)..(273): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcaagaaaccnggccaggctcccagcctcctcatctatgatcgccctccaccagggcccactggtactccccagccccaggttcagtggcaagtgggtctggggacaggagttcactctctattatcagcagcctgcagtctagaagtatttagcttagtttattactgtcagcagtataatgactgctacggtcggacgaaagggtaccaaagggtgaaaactacgaaacgtaagtgtaggctcgacacctatccgtag

SEQ ID NO: 439510 - DNA, 554 bp, Homo sapiens
  misc_feature: GZ8MTXP02G41LN.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaacttagcctggtaccagcagaaacctggccaggctcccaggctcctcatctatgatgcctccaccagggccacgtggtactccccagcccccaggttcaggtggcaagtggggtctggggacaggagttcactctcattatcagcagcctgcagtctagaatatttagcttaagtttattactgttcaagtctaagtataaatactggtacctgtcgttacctgggtaccgtttcggaccgaaacggggacctaaaacggtggaaaactccgtaaaacgtacgtaggtacggactacggactaaccg

SEQ ID NO: 439511 - DNA, 561 bp, Homo sapiens
  misc_feature: GZ8MTXP02HV7RT.39.40.D07.1.454.CMB.2.raw
  modified_base (206)..(206): a, c, t, g, unknown or other
  modified_base (291)..(291): a, c, t, g, unknown or other
  modified_base (298)..(298): a, c, t, g, unknown or other
  modified_base (379)..(379): a, c, t, g, unknown or other
  modified_base (387)..(387): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagcaacttagcctggtaccagcagaaacctggccaggctcccaggctcncatctangatgcctcaccagggccacgtggtactcccgagcccccaggttccagtggacaagtgggtctggggacagtacgttcactntacattancagcagcctgctagtctagagtattagctagtttattatgtacagcaagttataaagtgtaactgggtacccttacggttaccggaccgtaaacggggaacctaaaggggttaacggaaaacttaaccgaaaaccgagtaacgggtacggactacggaccaccatttccgtacg

SEQ ID NO: 439512 - DNA, 511 bp, Homo sapiens
  misc_feature: GZ8MTXP02FYYSW.39.40.D07.1.454.CMB.2.raw
  modified_base (410)..(410): a, c, t, g, unknown or other
  modified_base (438)..(438): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagtcaccctctcctgcagggccagtcagagtgttagcagcaacttagcctggtaccagcagaaacctggccaggctcccaggctcctcatctatgatgcctccaccagggccactggtactccccgagccccaggttcagtcggcaagttggggtctggggacaggtcgttcacttctcattatcagcagcctgcagtctgaagntttagctagtttatactgtcagcagtanagtgactgactacgtcgaccgaaggaccaaggtacgaaactacaaacgtaactgtacgctacgcacatctacg

SEQ ID NO: 439513 - DNA, 524 bp, Homo sapiens
  misc_feature: GZ8MTXP02FL39O.39.40.D07.1.454.CMB.2.raw
  modified_base (205)..(205): a, c, t, g, unknown or other
  modified_base (379)..(379): a, c, t, g, unknown or other
  modified_base (401)..(401): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccaggctcccaggctcctcatctatgatgcctccaccagggccactggactcccagccccaggttcagtggcaagtgggtctgggacagagttcactctcattancagcagcctgcagtctgaaagntttagctagtttatactgtacagcagtataatgaactggcctacgttcggccgtaaaggggacccaaagggttacggaaaacttacgaaaacggtaaactggtacggactaggcaccatctcg

SEQ ID NO: 439514 - DNA, 594 bp, Homo sapiens
  misc_feature: GZ8MTXP02HAN27.39.40.D07.1.454.CMB.2.raw
  modified_base (206)..(206): a, c, t, g, unknown or other
  modified_base (297)..(297): a, c, t, g, unknown or other
  modified_base (420)..(420): a, c, t, g, unknown or other
  modified_base (444)..(444): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagagtgtagcagcaacttagcctggtaccagcaagaaacctggccaggcctcccgaggcctcctnatctatgatcgccctccaccgacgggcccacgtcggtactccccgagcccccgtagggttccaggttcgggactaaaggttggggtccgtagggggacaggtacgttccactctactatttancgagcagcctgcagtctagaagtntttagcttagtttatactgtcagtcagtataagtgacgtggtaccttacggttccggaaccggtaaaggggaccgtaaaggggtacggtaaaacgtaaccgaaaacggtaacgttggtacgggacttacggacctacgtacttacgttcg

SEQ ID NO: 439515 - DNA, 586 bp, Homo sapiens
  misc_feature: GZ8MTXP02FL4B3.39.40.D07.1.454.CMB.2.raw
  modified_base (207)..(207): a, c, t, g, unknown or other
  modified_base (579)..(579): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagcccaccctgtctgtgtctccgaggggaaangtcaccctctcctgcagggccagtcagagtgttagcagcaacttagcctggtaccagcaagaaacctggaccaggcctcccgaggcctcctcatctatgatcgccctccaccgacgggccctacgtcggtactccccagccccctaggttccaaggtcggactaagttcggggtctgggggactaggtacgttccacttctactattatcagcagcctgctagtctagaagtatttagcttaagtttactacgtgttacagtaccgtaagtaataacgtgaccgtggtaccgtacggttacggaccgtaaaggggacctaaagggtacggaaactaacgaaacggtaactggacgctacggacctaaccgtnttcgtcg

SEQ ID NO: 439516 - DNA, 587 bp, Homo sapiens
  misc_feature: GZ8MTXP02G787K.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaacttagcctggtaccagcagaaacctggccaggcctccaggcctcctcatctatgatcgcctccaccagggccactggtactcccagccccaggttcagtggcaagtgggtcgtggggacagagttcacgtctactattacgcagcagccctagcctagtctagaagtatttagcttaagtttattacgtgtacgagtactaagtaattaagtgtacgtacggtaccgttacggttccgggacccgaaacggggtaccctaaaaggggtacggtaaaactaccgaaaacggtaacgtaaggttaccgggacttacggacctaacccgtagttcctttacg

SEQ ID NO: 439517 - DNA, 570 bp, Homo sapiens
  misc_feature: GZ8MTXP02HABPT.39.40.D07.1.454.CMB.2.raw
  modified_base (206)..(206): a, c, t, g, unknown or other
  modified_base (335)..(335): a, c, t, g, unknown or other
  modified_base (390)..(390): a, c, t, g, unknown or other
  modified_base (414)..(414): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtccaccctctcctgcagggccagtcagagtgttagcagcaacttagcctggtaccagcaagaaacctggccaggcctcccaggcctcctcatctatgatcgcctccaccgagggcccacgtggtacncccagcccctaggttcagtggacagtgggtctgggacagagttcactctcattancagcagcctgccagtctagaagtntttagctaagtttatactgtacagtacagttataagtgtacgttcgggtacccttacggttaccgggaccgaaagggggtaccctaaaagggggttagaaaaacgtaccgaaaacgtaacgtggtacggtactacggaccaccctattcgtttacg

SEQ ID NO: 439518 - DNA, 577 bp, Homo sapiens
  misc_feature: GZ8MTXP02GYF9M.39.40.D07.1.454.CMB.2.raw
  modified_base (206)..(206): a, c, t, g, unknown or other
  modified_base (319)..(319): a, c, t, g, unknown or other
  modified_base (394)..(394): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagagtgttagcagcaacttagcctggtaccagcagaaacctggccaggcctcccgaggcctcctcatctatgatcgcctccacccgngggccacgtggtactcccgagccccaggttcagtggcagttcgggtcgtgggacagtacgttcactctacattancagcagccctgctagtctagagtatttagcttaagtttatactgtacagactagtataagtgtacgtggaccttacggttaccggaaccgtaaggggtaaacccgtaaaggggttaacgaaaacgttaccgaaaacggtaacgtcggtacggacttacggaccaccgtaacgttccgtttacg

SEQ ID NO: 439519 - DNA, 505 bp, Homo sapiens
  misc_feature: GZ8MTXP02FV3OU.39.40.D07.1.454.CMB.2.raw
  modified_base (293)..(293): a, c, t, g, unknown or other
  modified_base (312)..(312): a, c, t, g, unknown or other
  modified_base (402)..(402): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagagtcaccctctcctgcagggccagtcagagtgttagcagcaacttagcctggtaccagcagaaacctggccaggctcccaggctcctnatctatgatgcctccaccngggccactggtatcccagccccaggttcagtggcaagtgggtctggggacaggagttcactctcattatcagcagcctgcagtctgaagntttagctagtttatactgtcagcagtataatgactggcctacgttcggacaaagggaccaaggtacgaaatacaaacgaacgtgtaggctagcacactcttag

SEQ ID NO: 439520 - DNA, 764 bp, Homo sapiens
  misc_feature: GZ8MTXP02HFL80.39.40.D07.1.454.CMB.2.raw
  modified_base (204)..(204): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccacctgtctgtgtctccgaggggaangtccaccctctcctgcagggccagtcagagtgtagcagcaacttgcctggtaccagcaagaaacctggccaggctcccgaggcctcctcatctatgatcgcctccaccgacgggccacgtggtactcccgagcccctaaggttccaggttcggactaaacgttggggtccgttagggggaacctaaggggtacgttttaccaaccgtttcttacgtaaactttacgtacctaaacggtccgaaacggtccccgtttgggacccttaaacgggtttacccgtaaacgggtaaaacggttaaagtttttaaaaccggggtacccttttaaaaggggttttttaacccttttaaagtttcggttacccgtaaagggtaccctaaaggttaattaaaagtcggttaaccgttacgggtaccccgtttaacggggtttcccggaacccggtaaaacgggggtaaccctaaaaggggttaacgggtaaaacttaaccgaaaaaccgggtaaacgttccggtaaggtacccggttacgaccgttaaccgtaactttcgtttaaccgg

SEQ ID NO: 439521 - DNA, 537 bp, Homo sapiens
  misc_feature: GZ8MTXP02HBBAF.39.40.D07.1.454.CMB.2.raw
  modified_base (207)..(207): a, c, t, g, unknown or other
  modified_base (217)..(217): a, c, t, g, unknown or other
  modified_base (295)..(295): a, c, t, g, unknown or other
  modified_base (326)..(326): a, c, t, g, unknown or other
  modified_base (350)..(350): a, c, t, g, unknown or other
  modified_base (372)..(372): a, c, t, g, unknown or other
  modified_base (378)..(378): a, c, t, g, unknown or other
  modified_base (385)..(385): a, c, t, g, unknown or other
  modified_base (387)..(389): a, c, t, g, unknown or other
  modified_base (391)..(391): a, c, t, g, unknown or other
  modified_base (416)..(416): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaanagtcaccctntcctgcagggccagtcagagtgtagcagcaacttagcctggtaccagcaagaaacctggaccaggctccaggctcctnatctatgatgcctcaccaggccacgtgtacnccagccccaggttcagtgctaagngggtctgggacagagttcatcncattancagcacncnnntntagagtatatatagttattatatanagtatagtaataatagtacgtacgtacgtacgtacggtacgaaacggaacgtaaacggtaaacggtaaaacgtaaacgtaaacgaaacgtaagtacggacgtacgacgtactactacgtcg

SEQ ID NO: 439522 - DNA, 576 bp, Homo sapiens
  misc_feature: GZ8MTXP02GWU9M.39.40.D07.1.454.CMB.2.raw
  modified_base (206)..(206): a, c, t, g, unknown or other
  modified_base (215)..(215): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctntcctgcagggccagtcagagtgttagcagcaacttagcctggtaccagcaagaaacctggccaggcctcccgaggcctcctcatctatgatcgcctccaccgagggcctacgtggtactccccgagccccaggttccaggtcggctaagtcgggtctggggacagtagttcactctacattactcagcagccctgctagtctagaagtagtttacgcttaagtttattacgtgtacagactagtataatgactggtacctacggttcggaccgtaaagggtacctaaagggtacggtaaaactaaccgaaaacggacttaacgggtacggacttacggacctaaccgtacgttcgtttacg

SEQ ID NO: 439523 - DNA, 592 bp, Homo sapiens
  misc_feature: GZ8MTXP02INR8K.39.40.D07.1.454.CMB.2.raw
  modified_base (206)..(206): a, c, t, g, unknown or other
  modified_base (295)..(295): a, c, t, g, unknown or other
  modified_base (403)..(403): a, c, t, g, unknown or other
  modified_base (469)..(469): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaacttagcctggtaccagcaagaaacctggccaggctcccagcctcctnatctatgatcgcctccaccgagggcccacgtcggtactccccgagccccctaggttccaggtggactaaagtggggtcctggggaacagagttccactctacatttancaagcagcctgctagtctagagtatttagacttagtttattactgtacaagtctaagtaataaagngtaacgtcggtaccttaacggttccggaacccgtaaaggggaaccctaaaaggggtacggtaaaaactaccgaaaaacggtaaccgtggtacggacttacgactaacccgtatttacgttccg

SEQ ID NO: 439524 - DNA, 517 bp, Homo sapiens
  misc_feature: GZ8MTXP02GO5A4.39.40.D07.1.454.CMB.2.raw
  modified_base (205)..(205): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccaggctcccaggctcctcatctatgatgcctccaccagggccactggtactccccagcccctacctttagtggcagtgggtctggggacagagttcactctcacatcagcagcctgcagtctagaagtatttgctagtttatactgtcaactagtacatgactggcctctctacgtttcggcggtagggaccaaagggtcggaagactacgaaaacgaacgtggtagactgacaccgtatcg

SEQ ID NO: 439525 - DNA, 612 bp, Homo sapiens
  misc_feature: GZ8MTXP02GCPB2.39.40.D07.1.454.CMB.2.raw
  modified_base (205)..(205): a, c, t, g, unknown or other
  modified_base (290)..(290): a, c, t, g, unknown or other
  modified_base (404)..(404): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccagctccgagctccnatctatgatcgcctccaccgacggcctacgtggtacctcccgagccccgtaggttcaaggtcggactaaggttcgggtcgtcggggacaggtacgttcacttctactaatttanacgagcacgcctagctagtctaggaatatttagcttaagtttactacgtgtacgagtacgtaagtaataagtacgtacgtcgggtaccgttaacggttaccgggaaccgaaacggggtaaaccgtaaaggggtaacggttaaaacctaacgaaaaacggtacggttaaggacggtacctacggacccaaccgtaacgttacctttacg

SEQ ID NO: 439526 - DNA, 527 bp, Homo sapiens
  misc_feature: GZ8MTXP02JHV6H.39.40.D07.1.454.CMB.2.raw
  modified_base (205)..(205): a, c, t, g, unknown or other
  modified_base (291)..(291): a, c, t, g, unknown or other
  modified_base (364)..(364): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgttagcagcaacttagcctggtaccagcagaaacctggccaggctcccaggctccncatctatgatcgcctccaccgagggccatggtactcccagccccaggttccagtgcaagtgggtctggggacngagttcactctcattatcagcagtccctgccagtctagaagtatttagcttagtttattactgtcagtcagttataatgactggccttaggttcggaccgaaggggaaccaagggtacgaaactacgaaaacgactggtacgcgtacgaccacgtactcttag

SEQ ID NO: 439527 - DNA, 538 bp, Homo sapiens
  misc_feature: GZ8MTXP02IP4JV.39.40.D07.1.454.CMB.2.raw
  modified_base (204)..(204): a, c, t, g, unknown or other
  modified_base (406)..(406): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaangtcaccctctcctgcagggccagtcagagtgttagcagcaacttagcctggtaccagcagaaacctggccaggcctccaggctcctcatctatgatcgcctccaccagggcccacgtggtactcccagccccaggttccagtggcaagtgggtctgggacagtgttcactctacattatcagcagcctgcagtctagaagtntttagctagtttatactgtcagctagtataatgactgtcctacggttccggacgaaaggggaccgaaagggtacggaaacttaacgaaacggtaaactggtaacgggtctacggacctacctacttcgttcg

SEQ ID NO: 439528 - DNA, 612 bp, Homo sapiens
  misc_feature: GZ8MTXP02JCLZR.39.40.D07.1.454.CMB.2.raw
  modified_base (206)..(206): a, c, t, g, unknown or other
  modified_base (215)..(215): a, c, t, g, unknown or other
  modified_base (291)..(291): a, c, t, g, unknown or other
  modified_base (327)..(327): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctntcctgcagggccagtcagagtgttagcagcaacttagcctggtaccagcagaaacctggccaggctccaggctccncatctatgatgcctccaccgagggccactggtaccncccgacgccccgtaggttccaggtcggactaaggttcggggtcgtggggaactaggtacgttccacttcctactaattactacgacgcacgtccctagctacgtctagtaagttagtttacgacgtttaagtttacttacttgtacagtactaagtaataagtcgtacgttcggtaccgttacggttaccggaacgtaaacggggtaaccgtaaagggtaacggtaaaacgtaacgaaaacgtacgtaaggtacggtacgtacgacctaacctacgttacgttcg

SEQ ID NO: 439529 - DNA, 544 bp, Homo sapiens
  misc_feature: GZ8MTXP02F6UYS.39.40.D07.1.454.CMB.2.raw
  modified_base (206)..(206): a, c, t, g, unknown or other
  modified_base (366)..(366): a, c, t, g, unknown or other
  modified_base (391)..(391): a, c, t, g, unknown or other
  modified_base (414)..(414): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtcaccctctcctgcagggccagtcagagtgttagcagcaacttagcctggtaccagcagaaacctggccaggctcccaggctcctcatctatgatcgccctccaccgagggccctacgtggtactccccagccccaggttcagtggcaagtggggtcnggggacagacgttcactctcattancagcagcctgcagtctagaaagntttagctagtttatactgtacagtctagtataagtgactggtccttaacgttcggaccgtaaagggacctaaagggtacgaaaataccgaaaacgtaacgtggtcggactacggacaacctatccttacg

SEQ ID NO: 439530 - DNA, 561 bp, Homo sapiens
  misc_feature: GZ8MTXP02G7TYW.39.40.D07.1.454.CMB.2.raw
  modified_base (205)..(205): a, c, t, g, unknown or other
  modified_base (385)..(385): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccaggcctcccaggcctcctcatctatgatcgcctccaccgagggccacgtggtactcccagcccctaggttcagtgcaagtgggtctgggacagagttcactctcattancagcagcctgcagttctagaagtatttagcttaagtttacttactgtcagtctaagtataatgtacgtggtaccttacggttcggaccgaaacggggtacctaaaggggtacgtaaaacgtaccgaaaacggtaacgttggtacggtacgttacggaccgaacctacgttcttacg

SEQ ID NO: 439531 - DNA, 561 bp, Homo sapiens
  misc_feature: GZ8MTXP02HU0AF.39.40.D07.1.454.CMB.2.raw
  modified_base (205)..(205): a, c, t, g, unknown or other
  modified_base (213)..(213): a, c, t, g, unknown or other
  modified_base (487)..(487): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaaangtcacctntcctgcagggccagtcagagtgttagcagctaacttagcctggtaccagacaagaaacctggccaggctcccgaggcctcctcatctatgatcgccctccacgacgggcctacgtcggtactcccacggtccccgtaggttccagtacggggctaaaggttggggtcgtggggaaccaggtacgttccaactcttacattactcgagcacgcctagctagtctaggaagtagtttaagcttaagttttacttagtagtacagtactagtaatangtactggtactacgttcgacgaaggacaggtacaaactacgaaacgtagtgtacggactcgacacctattctcg

SEQ ID NO: 439532 - DNA, 667 bp, Homo sapiens
  misc_feature: GZ8MTXP02JC1CC.39.40.D07.1.454.CMB.2.raw
  modified_base (206)..(206): a, c, t, g, unknown or other
  modified_base (397)..(397): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagagtgtagcagcaacttagcctggaccagcaagaaacctggccaggcctcccgaggcctcctcatctatgatcgcctccaccgagggccacgtcggtactccccgagcccctaggttcaggtggacagtgggtcgtaggggactaggtacgttccacgttcctntaatttactaccgaagccgacgtcccgttaggacctaagggttctaagggtaaaagttagtttttaacggactttaaaggtttttaacttaacgttcggtttaccaagggtaccttaaaggttaacttaaaagtcggtaaaccgttcgggggtacccttaaacggggtttacccgggaaccgtaaaacgggggaaccctaaagggggttaacggaaaacttacggaaaaaccgtagtggtacgtcgtacgacctaaccgtagttcctacg

SEQ ID NO: 439533 - DNA, 547 bp, Homo sapiens
  misc_feature: GZ8MTXP02ID8ST.39.40.D07.1.454.CMB.2.raw
  modified_base (204)..(204): a, c, t, g, unknown or other
  modified_base (349)..(349): a, c, t, g, unknown or other
  modified_base (355)..(355): a, c, t, g, unknown or other
  modified_base (365)..(365): a, c, t, g, unknown or other
  modified_base (372)..(372): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccacctgtctgtgtctccaggggaaangtcacctctcctgcagggccagtcagagtgttagcagcaacttagcctggtaccagcagaaacctggccaggctccgaggcctctcatctatgatgcctccacagggccatggactccagccccaggttcagtgcaagtgggtcngggacnggattcactntcattancagcacgctgctagtctagagtattagacttaagtttaatttacgtgtacagtacgtaaagtataagtcgtaacgtcggtaccttacggttccggaaccggaaagggtaacctaaaagggtacggtaaaactaccgtaaaacgaacgtggtacggctacgacctacgtattcgtg

SEQ ID NO: 439534 - DNA, 544 bp, Homo sapiens
  misc_feature: GZ8MTXP02HBB8O.39.40.D07.1.454.CMB.2.raw
  modified_base (205)..(205): a, c, t, g, unknown or other
  modified_base (411)..(411): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgttagcagcaacttagcctggtaccagcagaaacctggccaggcctcccaggcctcctcatctatgatgcctcaccgagggccactggtactcccagcccccaggttccagtggcaagtgggtctggggacagtagttcactctacattatcagcagccctgccagtctagaagtntttagcttagtttattactgtacagtcaagttataagtgactggaccttacggttcggacgaaagggaccaaagggttacggaaactacgaaaacgtaacgtggtacggacttacgacctaccgattccgtag

SEQ ID NO: 439535 - DNA, 542 bp, Homo sapiens
  misc_feature: GZ8MTXP02I8OYA.39.40.D07.1.454.CMB.2.raw
  modified_base (205)..(205): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgttagcagcaacttagcctggtaccagcaagaaacctggccaggcctcccaggctcctcatctatgatcgcctccaccgagggccactggtactcccgagcccctaggttccagtggctaagtgggtctggggacagtagttcactctactattatcagcagccctgcctagtctagaagtatttagcttagtttacttactgtacagtctagtataagtgactggtcctacggttcgacgtaaaggaccgtaaaggtaggaaaactacgaaacgtaactggtacgcgtacgacacgtactcgttac

SEQ ID NO: 439536 - DNA, 579 bp, Homo sapiens
  misc_feature: GZ8MTXP02H6ZC4.39.40.D07.1.454.CMB.2.raw
  modified_base (206)..(206): a, c, t, g, unknown or other
  modified_base (401)..(401): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaanagtccaccctctcctgcagggccagtcagagtgtagcagcaacttagcctggtaccagcagaaacctggccaggcctccagcctcctcatctatgatcgccctccaccagggccactggtactccccagccccaggttccaggtcggacaagttgggtcgtggggaacaggtagttccacttctcctaatttacncagcagtcctgctagtcgtagtagtatttagactttaagtttattacgtgtacagtactaagttatagtagtacgtcggtaccgttacggtacgggaccgtaaacgggaccgtaaaggtaacgtaaacgtaacgaaacggtacgtggtacggactacgtacctaccgtattaccgtcg

SEQ ID NO: 439537 - DNA, 515 bp, Homo sapiens
  misc_feature: GZ8MTXP02GKG9S.39.40.D07.1.454.CMB.2.raw
  modified_base (205)..(205): a, c, t, g, unknown or other
  modified_base (305)..(305): a, c, t, g, unknown or other
  modified_base (338)..(338): a, c, t, g, unknown or other
  modified_base (374)..(374): a, c, t, g, unknown or other
  modified_base (378)..(378): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagataccaccggagaaattgtgttgacgcagtctccagccaccctgtctttgtctccaggggaaangccaccctctcctgcagggccagtcagagtgttagcagcacctacttagcctggtaccagcagaaacctggccaggctcccaggctcctcatctatggtncatccaccgagggcccacgtggcactccccganaggttccagtgcagtggtctgggcagacttcactcncacntcagcagactggagcctgaagtatttgactagtgtattactgtcagcagtatggtagctacaccttccaccttcggacctaagggacacgtacgtggacgtaactaaacgaacgtggtagactgacactactctacg

SEQ ID NO: 439538 - DNA, 541 bp, Homo sapiens
  misc_feature: GZ8MTXP02FLH96.39.40.D07.1.454.CMB.2.raw
  modified_base (301)..(301): a, c, t, g, unknown or other
  modified_base (312)..(312): a, c, t, g, unknown or other
  modified_base (326)..(326): a, c, t, g, unknown or other
  modified_base (346)..(346): a, c, t, g, unknown or other
  modified_base (369)..(369): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaagagtcaccctctcctgcagggccagtcagagtgttagcagcaacttagcctggtaccagcaagaaacctggccaggctcccaggctcctcatctangatgcctcacnggccactgatccanccccagtcagtgcatgggcngggacagagttcactctcattancagcagcctgctagtctagaatatttagcttaagtttacttacgtgtacagtactaagttaataagtgactcggtaccttaacggtcggaaccgaaaggggacctaaaggggtaacgaaaactaaccgaaaacgtacgtaaggtacggactacgaccaacctcttaccgtag

SEQ ID NO: 439539 - DNA, 553 bp, Homo sapiens
  misc_feature: GZ8MTXP02JK0MW.39.40.D07.1.454.CMB.2.raw
  modified_base (205)..(205): a, c, t, g, unknown or other
  modified_base (395)..(395): a, c, t, g, unknown or other
  modified_base (444)..(444): a, c, t, g, unknown or other
  modified_base (448)..(448): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgtagcagcaacttagcctggtaccagcaagaaacctggaccaggcctcccaggcctcctcatcctatgatcgccctaccacccgagggccacgtggtactcccagcccctagggttccagtgcaagttggggtctgggacagacgttcactctctaattntcagcagtcctgcctagtctagaatatttagctagtttattacgtgtanacgnaggtataagtgactgggtcctacggttcggacgaagggtaaccaaggggtagaaaactacgaaaacgtacgtaaggtacggtactacggacctaccgattcttcg

SEQ ID NO: 439540 - DNA, 566 bp, Homo sapiens
  misc_feature: GZ8MTXP02GC1N5.39.40.D07.1.454.CMB.2.raw
  modified_base (400)..(400): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaagagtccaccctctcctgcagggccagtcagagtgttagcagcaacttagcctggtaccagcaagaaacctggccaggcctcccgaggctcctcatctatgatcgccctccaccgagggccactggtactcccagccccaggttcagtggacaagtggggtctggggacaggtagttccacgttctactaattancaagcagccctgctagtctagaaagtatttaggacttaagttttatacgtgtacagactaagtaataagtgacgtggtacccttacggttccggacgaaaggggtaccaaagggtacgaaaactaccgaaaacgtactggacggactacgaccactattcgttacg

SEQ ID NO: 439541 - DNA, 540 bp, Homo sapiens
  misc_feature: GZ8MTXP02IO4JK.39.40.D07.1.454.CMB.2.raw
  modified_base (205)..(205): a, c, t, g, unknown or other
  modified_base (303)..(303): a, c, t, g, unknown or other
  modified_base (314)..(314): a, c, t, g, unknown or other
  modified_base (346)..(346): a, c, t, g, unknown or other
  modified_base (418)..(418): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaaangtcacctctcctgcagggccagtcagagtgttagcagctaacttagcctggtaccagcaagaaacctggccaggcctccaggctcatcatctatggtncatcccaccgnggccatggtactcccgagtccctaccgtttgngctaggtgggtctggggacaggacgttcacgtctacacctatcagcagtccgtgcctagtcgtacgtaagtnttttagcttagtttacttacttgtacaactagtactatgactcgtctctctacgttcgggacggtacggaaccgaggtcggacgtagtacgaaaacgtacgtggtacggactcgacactacg

SEQ ID NO: 439542 - DNA, 565 bp, Homo sapiens
  misc_feature: GZ8MTXP02IZ3X8.39.40.D07.1.454.CMB.2.raw
  modified_base (204)..(204): a, c, t, g, unknown or other
  modified_base (293)..(293): a, c, t, g, unknown or other
  modified_base (314)..(314): a, c, t, g, unknown or other
  modified_base (382)..(382): a, c, t, g, unknown or other
  modified_base (405)..(405): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccacctgtctgtgtctccgaggggaanatcacctctcctgcagggccagtcagagtgttagcagcaacttagcctggtaccagcaagaaacctggccaggcctccgaggcctcctnatctatgatcgcctccaccgnggccacgtggtactcccagcccaggttcagtgacagttgggctgggactgacgttcacgtctcattancagcagcctgcagtcagtaagtntttagcttaagtttattactgtcagtctaagtacttaagtcgtacgtaggtaccttacggttaccggacccgaaaaggggacccaaaggggttacggaaacttaaccgaaaaccgtaacgtggtacgggtacttacggacctaacctacgttcgtttacg

SEQ ID NO: 439543 - DNA, 604 bp, Homo sapiens
  misc_feature: GZ8MTXP02JIB4V.39.40.D07.1.454.CMB.2.raw
  modified_base (206)..(206): a, c, t, g, unknown or other
  modified_base (243)..(243): a, c, t, g, unknown or other
  modified_base (269)..(269): a, c, t, g, unknown or other
  modified_base (294)..(294): a, c, t, g, unknown or other
  modified_base (334)..(334): a, c, t, g, unknown or other
tcagtcgcactagtcacgaccggtgctcgatttagtgatagagcgtaacaacagagggggaggaactgctcagttaggacccagacggaaccatggaagcccccagcgcagcttctcttcctcctgctactctggctcccagattccactggagaaatagtgatgacgcagtctccagccaccctgtctgtgtctccaggggaaangtcaccctctcctgcagggccagtcaggagttgtagnagcaacttgctggacagcaagaaccngccagcctccgagcctctcatctangatcgcctacccaacgacgggccctaacgtcggtaacccnccgacgtcccgtaaggtcaggtcgacgtaaggtcgggtcgagggaactagtactcacttctataattacacgacgcacgccgtgacgtagttacgtaagtaaagttatttacgtacgtttaaagttttaactacgttcgtacaagtaactaagtaataagtcgtacgtcgtaccgttacggtacgaacggaaagggtacgtaaagggtaacgaaaacgtaacgaaaacgtacgtggtacgaacgtacgaacctaacgttacgtctttacg

SEQ ID NO: 439544 - DNA, 604 bp, Homo sapiens
  misc_feature: GZ8MTXP02IRT5I.39.40.D07.1.454.CMB.2.raw
  modified_base (205)..(205): a, c, t, g, unknown or other
  modified_base (294)..(294): a, c, t, g, unknown or other
  modified_base (413)..(413): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaaangtcacctctcctgcagggccagtcagagtgttagcagcaacttagcctggtaccagcaagaaacctggcccaggcctcccaggcctccncatctatgatcgcctccaccgacgggccacgtcggtactcccgacgccctaggttccaggttcggactaaagttcgggttcgtaggggactaggtacgttccaacttcttactatttancagcagccctgcctagtcgtagaagtatttacgacgttagttttattacgttgtacacgtataagttaattaatggtaacttcgggtaccttaacgggttcggaaccggtaaacggggacctaaaagggggtacgtaaaacgttaccgaaaaggtacgttaaggcggtacgtacgaccactacttcgttcg

SEQ ID NO: 439545 - DNA, 516 bp, Homo sapiens
  misc_feature: GZ8MTXP02I7W6Z.39.40.D07.1.454.CMB.2.raw
  modified_base (205)..(205): a, c, t, g, unknown or other
  modified_base (325)..(325): a, c, t, g, unknown or other
  modified_base (400)..(400): a, c, t, g, unknown or other
  modified_base (405)..(405): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctctcctgcagggccagtcagagtgttagcagcaacttagcctggtaccagcagaaacctggtcaggctcccaggctcctcatctatgatgcctccaccagggccactggtacncccagccccaggttcagtggcaagtgggtctggggacagtacgttcactctacattatcagcagccctgcagtcngaatntttagctagtttattactgtcagcagtatatgactgccttagtcggacaaagggaccaaagggtacgaaactacgaaacgtaactggtggactacgacaccgattcttacg

SEQ ID NO: 439546 - DNA, 604 bp, Homo sapiens
  misc_feature: GZ8MTXP02IPHRL.39.40.D07.1.454.CMB.2.raw
  modified_base (205)..(205): a, c, t, g, unknown or other
  modified_base (317)..(317): a, c, t, g, unknown or other
  modified_base (332)..(332): a, c, t, g, unknown or other
  modified_base (400)..(400): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccatggagaaatagtgatgacgcagtctccagccaccctgtctgtgtctccgaggggaagngtccaccctctcctgcagggccagtcagagtgttagcagctaacttagcctggtaccagcaagaaacctggccaggcctccgagcctcctcatctatgatcgcctccaccgnggcccacgtggtacncccagcccctaggttccaggtcggactaagtggggtcctaggggacaggtacttccactctcaatttnactagcagtccctagcctagtctagaagtagtttagcttaagttttacttacgttgtacaagtactaagttaatagttggacgttcggtacccgttacggttccggaaccggtaaacggggaaccgtaaaggggtaaacggtaaaactaacggaaaaccgtacgttaaggtacggacttacggacctaaccgtattccgttacg

SEQ ID NO: 439547 - DNA, 517 bp, Homo sapiens
  misc_feature: GZ8MTXP02F3VIF.39.40.D07.1.454.CMB.2.raw
  modified_base (205)..(205): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaanagtcaccctctcctgcagggccagtcagagtgttagcagcaacttagcctggtaccagcagaaacctggccaggctcccaggctcctcatctatgatgcctccaccgagggccactggatcccagccccaggttcagtggcaagtgggtctgggacaggagttcactctcattatcagcagcctgcagtctagaagtatttagctagtttattactgtacagtacagtataatgactgccttacgtcgacgaagggaccaaggtacgaaactacgaaacgtaacgtggtaggactacggacacgtactctcg

SEQ ID NO: 439548 - DNA, 603 bp, Homo sapiens
  misc_feature: GZ8MTXP02IJSCE.39.40.D07.1.454.CMB.2.raw
  modified_base (206)..(206): a, c, t, g, unknown or other
  modified_base (404)..(404): a, c, t, g, unknown or other
  modified_base (456)..(456): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcacctctcctgcagggccagtcagagtgttagcagctaacttagcctggtaccagcaagaaacctggccaggcctcccgaggcctcctcattctatgatgccctccaccagggccacgtggtactcccagccccaggttccagttggactaagttcggggtcgtggggactaggacgttccaactctacatttacncgagcagcctgctagtctagagttattagtacttaagtttacttacgtgtanacgtagtaagttaataacgtcgtacgttcggtaccgttacggttaccggaacggtaacgggaaaccgtaaagggtaaacggtaaacgtaaaccggtaaaacgtacggttaaggtacgtacgtacgaccctacgttacgttcgttacg

SEQ ID NO: 439549 - DNA, 558 bp, Homo sapiens
  misc_feature: GZ8MTXP02G2KJ0.39.40.D07.1.454.CMB.2.raw
  modified_base (206)..(206): a, c, t, g, unknown or other
  modified_base (294)..(294): a, c, t, g, unknown or other
  modified_base (330)..(330): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagcaacttagcctggtaccagcaagaaacctggccaggctcccaggcctccncatctatgatcgcctccaccgagggccacgtgtacncccagccccgtagtcaggtgcaagttgggtctgggacagtacgttcacttctactattactcgagcagccctagcgtagtctaagtaaagtattttagcttaagttttactcgtagttacagactagttaataagtgtacgtcgggtacttacggtacggacgaaagggaccaaagggtacgaaactaccaaagacgtggtacggactacgacctacgtatcgttacg

SEQ ID NO: 439550 - DNA, 575 bp, Homo sapiens
  misc_feature: GZ8MTXP02GEBRC.39.40.D07.1.454.CMB.2.raw
  modified_base (206)..(206): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgtagcagctaacttagcctggtaccagcaagaaactggccaggcctccagcctcctcatctatgatcgccctaccaccgagggccctacgtggtaactccccgagccccgtaggttccaggtcggactaagttggggtcgtgggacaggtacgttcactctactattactcagtcagcctagcctagtcagaatatttagacttaagtttatactgacagactaagtaatagtcgtactcggtacctacgggtacggaccgtaaaggggacctaaagggtacgaaaacgtaacaaaccggtaagtggtacggactacggacctaacgtacgttacttcg

SEQ ID NO: 439551 - DNA, 590 bp, Homo sapiens
  misc_feature: GZ8MTXP02JM0A8.39.40.D07.1.454.CMB.2.raw
  modified_base (206)..(206): a, c, t, g, unknown or other
  modified_base (294)..(294): a, c, t, g, unknown or other
  modified_base (300)..(300): a, c, t, g, unknown or other
  modified_base (399)..(399): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgtagcagcaacttagcctggtaccagcaagaacctggccaggcctccgaggcctcctnatctangactcgcctaccgaccgagggccaagtcggtactcccgagtcccccaggttcagtcggctaagtcgggtctaggggactaggtacgttcactctacacngtcagcacgcctgccagttcgtagagttactttagacttagtttaacttcgttagtacaaactaagtaactaagtcgtactggtacctactcgtaccggtttcgggacgggtacgggtaacccgaaggggttcggaaagacgttaaaccgaaaacggtaacgtggtacggactcggtaacccgacttaccg

SEQ ID NO: 439552 - DNA, 629 bp, Homo sapiens
  misc_feature: GZ8MTXP02HV459.39.40.D07.1.454.CMB.2.raw
  modified_base (204)..(204): a, c, t, g, unknown or other
  modified_base (359)..(359): a, c, t, g, unknown or other
  modified_base (429)..(429): a, c, t, g, unknown or other
  modified_base (434)..(434): a, c, t, g, unknown or other
  modified_base (481)..(481): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaangtcacctctcctgcgagggccagtcagagtgttagcagcaacttagcctaggtaccagcaagaaacctggaccaggcctccccgaggcctcctacagttcctaatggactcggaccccttacccgaacccgacggggccctaacgtacggtaccnccccgaagcccccgtaggtttacaggtcgggacaacggttgggtcgtagggactaggtacttcactctanattancagcacgctgctagtctagagtactttagcttaagttttatacgttntacgagtacgtaaagtataaagtcggtactacggtaccgttaacggtcggaaaacccggtaaaggggtaaaccgaaagggttaaccgaaaacgtaaaccggtaaaagtaacggtgttacgaccgtacgacctaaccgtagttcgtacg

SEQ ID NO: 439553 - DNA, 573 bp, Homo sapiens
  misc_feature: GZ8MTXP02GHBID.39.40.D07.1.454.CMB.2.raw
  modified_base (205)..(205): a, c, t, g, unknown or other
  modified_base (214)..(214): a, c, t, g, unknown or other
  modified_base (420)..(420): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaangtcaccctntcctgcagggccagtcagagtgttagcagcaacttgcctggtaccagcagaaacctggccaggcctcccaggcctcctcatctatgatcgcctccaccgagggcccacgtcgtactcccagccccaggtcagtgcaagtgggtctgggacagtacgttcacgtctactattatacgagcacgtccctagcctagttctagaaagtntttagcgttagtttattacgtgtacagactaagttactaagtcgtactcgggtacccttacgggtacgaccgtaaacgggacctaaagggtacgaaacgtaaccgaaacgtaacgtggttacggacttacggacctaaccgactttacgttcg

SEQ ID NO: 439554 - DNA, 594 bp, Homo sapiens
  misc_feature: GZ8MTXP02IM4UV.39.40.D07.1.454.CMB.2.raw
  modified_base (204)..(204): a, c, t, g, unknown or other
  modified_base (288)..(288): a, c, t, g, unknown or other
  modified_base (297)..(297): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaangtccaccctctcctgcagggccagtcagagtgttagcagcaacttagcctggtaccacagaactggccaggctccaggctcctnatctatggncatcccaccgagggccagtcggtactcccaacgtggttcccaggtcggcaggttgggtctaggggacaggtaactttcgaccttcctcacctatcagcagcctgacagttctagtaagtacgtttaggtagtttttatttcgttgtactagtactaagttaataaacgttacgtcggtccttacgtcgttccgtacgggtaccgtttacgggaccggtaaagggaaccgtaaaacggtacggtaactaaacgaaacgtaacgtgtcgggtactcggacctacctacgttcgtttacg

SEQ ID NO: 439555 - DNA, 590 bp, Homo sapiens
  misc_feature: GZ8MTXP02ITGK9.39.40.D07.1.454.CMB.2.raw
  modified_base (206)..(206): a, c, t, g, unknown or other
  modified_base (396)..(396): a, c, t, g, unknown or other
  modified_base (412)..(412): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgttagcagcaacttagcctggtaccagcaagaaacctggccaggcctccaggcctcctcatctatgatcgcctccacccgagggccacgtggtactcccagcccctaggttcagtggctaagtggggtctggggacaggtacgttcactctctagtttancagcagcctgcagtcngaatatttagctagtttatactgtacagtactagtataacgtagaccgttggtacccgttacggttaccgggaccgtaaaacgggggacccgtaaaaggggtacggaaaacttaaccgaaaaccggtaaacgtgggtaaccggtacgtacggaccctaaaccgtacgttcctttaccg

SEQ ID NO: 439556 - DNA, 560 bp, Homo sapiens
  misc_feature: GZ8MTXP02G6XN6.39.40.D07.1.454.CMB.2.raw
  modified_base (206)..(206): a, c, t, g, unknown or other
  modified_base (418)..(418): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaaggggaaangtcaccctctcctgcagggccagtcagagtgttagcagcaacttagcctggtaccagcagaaacctggccaggctcccaggcctcctcatctatgatcgcctcaccgaggccacgtgtactcccagcccctaggttccagtcggactaagtgggtcgtgggacaggtacttcacgtctacaccagtcacgcacgccctgcagtctagaattnttttagtactttatactgtcagtacagtatgactacgtgtcctactacgtacgtttcggaccgtacggggtaccgtagggttacggaacgtaacgttacgaaaaccggtagtacgggtacggtactacggaccctaactacg

SEQ ID NO: 439557 - DNA, 572 bp, Homo sapiens
  misc_feature: GZ8MTXP02G4HOF.39.40.D07.1.454.CMB.2.raw
  modified_base (206)..(206): a, c, t, g, unknown or other
  modified_base (260)..(260): a, c, t, g, unknown or other
  modified_base (295)..(295): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcaccctctcctgcagggccagtcagagtgtagcagcaacttgcctggtaccngcaagaaacctggaccaggcctcccgaggcctccncatctatgatcgccctccaccgagggccacgtggtactccccgagcccctaggttcagtggactaagttggggtctggggaacaggtacgttccacgttctactattactcagcgacgcctgctagtctagaagtatttagcttaagtttacttagtagttacagtactagttaatagtagtacgtcggtaccgtacggttacggaccgtaagggaaccgtaaagggtacggtaaactaccgaaagtacgtggtacgactacgacacctagtcttcg

SEQ ID NO: 439558 - DNA, 580 bp, Homo sapiens
  misc_feature: GZ8MTXP02FQ9N1.39.40.D07.1.454.CMB.2.raw
  modified_base (206)..(206): a, c, t, g, unknown or other
  modified_base (241)..(241): a, c, t, g, unknown or other
  modified_base (364)..(364): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaagngtcaccctctcctgcagggccagtcagagtgttancagcaacttgcctggaccagcaagaacctggccaggcctcccaggcctcctcatctatgatcgcctccaccgagggccactggtactccccagccccaggttcagtggactaagtcggggtcnggggacagtagttccaagttctctaattactcagcacgcctgctagtctagaagtctttagcttagtttactcgtatcgagctaagttataagttcgacgtcggtaccgttaccggttacgggaaccgaaaggggttaaccaaagggggttacgaaaacgttaccgaaaacggtaacgtaacggttggaccttacggacctaacgtactttcgtcg

SEQ ID NO: 439559 - DNA, 574 bp, Homo sapiens
  misc_feature: GZ8MTXP02JEW1Q.39.40.D07.1.454.CMB.2.raw
  modified_base (207)..(207): a, c, t, g, unknown or other
  modified_base (302)..(302): a, c, t, g, unknown or other
  modified_base (441)..(441): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtcctccagccaccctgtctgtgtctccgaggggaaanagtccaccctctcctgcagggccagtcagagtgttagcagcaacttagcctaggtaccagcaagaaacctggccaggcctccccgaggcctcctnatctatgatcgcctccaccgagggccagtcggtactcccagcccctaggttcagtgcaagttgggctgggacaggtgttcactctctaagttatccgagcagcctgcctagtctagaagtatttaagcttaaaggtttntacgttgctagcgtaattatagttagacgttcgggtaccttacggttaccgggacgaaggggtaacccgaaagggttacggaaaacttacgaaacgtaacgtggtacggactacgaccgaactcgtactttcg

SEQ ID NO: 439560 - DNA, 632 bp, Homo sapiens
  misc_feature: GZ8MTXP02HM7TN.39.40.D07.1.454.CMB.2.raw
  modified_base (207)..(207): a, c, t, g, unknown or other
  modified_base (301)..(301): a, c, t, g, unknown or other
  modified_base (385)..(385): a, c, t, g, unknown or other
  modified_base (502)..(502): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatgtgatgacgcagtctccagcccaccctgtctgtgtctccgaaggggaaangtccaccctctcctgcagggccagtcagagtgtagcagctaacttagcctggtaccagacaagaaacctggaccaggcctcccgaggcctcctnatctatgatcgccctaccgaccgacgggcctacgtcggtactcccgaggcccctaggttcaggtcggactaaggttcgggtcgnggggacagtacgtttccacgtctacatttacacgagcacgtcccttaggcctagtcgtaagtaaaggttatttaggactttaagttttactttacgtgttacgagtcgtaaagttanaagttcgacgttcggaccgttacgggtacggaccggtaaaggggaaccgtaaaggggttaacgaaaacgttaccgaaaacgggtacgttaaggggtacgacgttacgaccctaccgtactttcgtttacg

SEQ ID NO: 439561 - DNA, 668 bp, Homo sapiens
  misc_feature: GZ8MTXP02G9M2T.39.40.D07.1.454.CMB.2.raw
  modified_base (207)..(207): a, c, t, g, unknown or other
  modified_base (439)..(439): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaaggggaaangtccaccctctcctgcgagggccagtcagagtgtagcagcaacttgcctggtaccagcaagaaacctggaccaggcctcccgaggcctcctcatcctatgatcgccctccaacccgagggccctacgtcggtaacctccccgaggccccccgtaggtttccaggtcggaacgtaaggttcggggtcctagggggaactacgggtacgttccaacgttctactaaagtttacncgaagtccgacgtccctaggacctaggttactaagaaagttatttaacggctttaaagtttttactacgtagttacgaagtacgtaaagttactaaagtcggacgttaccgggtaccttaccggggttaccggaaccggaaaacggggtaacctaaaggggtaacgtaaaactaaacccggtaaaacgaacggttcggaggtaccacgacgtacctagtttccgttacg

SEQ ID NO: 439562 - DNA, 571 bp, Homo sapiens
  misc_feature: GZ8MTXP02FMRB8.39.40.D07.1.454.CMB.2.raw
  modified_base (208)..(208): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagcccaccctgtctgtgtctccgaggggaaagngtcaccctctcctgcagggccagtcagagtgttagcagcaacttagcctggtaccagcaagaaacctggccaggcctcccgaggctcctcatctatgatcgcctccaccagggcccacgtggtactccccagcccctaggttcaggtggcaagtcggggtctgggggacaggtagttcaacgtctcaattatcagcagccctgcagtcagaaagtatttaagcttaagttttacttacgtgttacagtactaagttaactaagtgacttcggacccttacggttaccggacgtaaagggaccgtaaagggtacgaaaactaacgaaaacgtacgtaagtcggactcgacctacgactcttacg

SEQ ID NO: 439563 - DNA, 729 bp, Homo sapiens
  misc_feature: GZ8MTXP02GIU70.39.40.D07.1.454.CMB.2.raw
  modified_base (207)..(207): a, c, t, g, unknown or other
tcagtcgcactagtcacgaccggtgctcgatttagtgatagagcgtaacaacagaggggggaggaactgctcagttaggacccagacggaaccatggaagccccagcgcagcttctcttcctcctgctactctggctcccagattccactggagaaatagtgatgacgcagtctccagccaccctgtctgtgtctcgaaggggaaanagtccaccctctcctgcgagggccagtcagtagtgttagcagactaacgttacgccgtaggtaccagacaaacgaaaccgtcgggaccacggccctaccccgaaggtccctcctacagtctatgactcgccctaccgacccgacgggccctacgtcggtaacctccccgacggtaccccgtacgggttcgaggtcggacgtaaggttcggggtcgtacggggtaacgtaaggtacgttcccaaacgttctaccaccgtactccgaacgacgtaacgtacgttacggaccgtaccgttaaggtaaaagtttacgtttacggacgttaaggtttacgtttaacgtttacgtcggttaacgaagttaccggtaaggttaggtacggtactaccgttacctacccttcccgtaaaccggttcccggaaaacggtaaacgggaaaccgtaacggtaaacgttacggggtaaaacgtaaaacggttaaaaaccgtaggtacggtacgtaccgtacgaccctacgtaag

SEQ ID NO: 439564 - DNA, 716 bp, Homo sapiens
  misc_feature: GZ8MTXP02F696W.39.40.D07.1.454.CMB.2.raw
  modified_base (206)..(206): a, c, t, g, unknown or other
  modified_base (298)..(298): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtcacctctcctgcagggccagtcagagtgttagcagactaacttagcctggtaccagcaacgaaacctggccaggcctcccgaggctcctnatctatgaactcgtccctccaaccgacgggccctacgttggtacctccccgaggcccccgtaaggttcctaaggtcggaccaaaggttcggggtctcgggggaaactaggggtaccgttcctaaacttcttacctaaagttttaaccctcgaacgtccgtaacgtcccgtacgaccgttaagttacgtaagtaaagttacgtttaacgtacgtttaagtttttacgttacgttggtaacgtacgtacgttaagttaagttaacgtacgtaccgtaccggtacccgttacgggtaaccggaaccgggttaaacgggtaacgtaaaaggggtaaccgtaaaaccgtaaaccggtaaaacgttaacgggtcggtaccggtaacgttaccgggaccttaaaccgtttacgtttaccgttacg

SEQ ID NO: 439565 - DNA, 605 bp, Homo sapiens
  misc_feature: GZ8MTXP02G4G7B.39.40.D07.1.454.CMB.2.raw
  modified_base (206)..(206): a, c, t, g, unknown or other
  modified_base (289)..(289): a, c, t, g, unknown or other
  modified_base (322)..(322): a, c, t, g, unknown or other
  modified_base (400)..(400): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagagtgttagcagcaacttagcctggtaccagcagaacctggccaggctccagctcncatcatgatgcctacaccgaggccagtggtacnccccgagcccctaggttcaaggtgactaagtcggggtctaggggaactagggtacgttccaacttctactaatttacnccgaagccaagtcccgtagcctaagtctaagaacgtatttagacttaagtttacttacgtgttacaagtcctaaagttaataaagtcgtacgttacggtaccgtaacggttccgggaaccgaaagggggtaaccctaaagggttacggaaaacttaccgaaaacggtaactgggtacgacgtacggacctaacgtactcgttacg

SEQ ID NO: 439566 - DNA, 766 bp, Homo sapiens
  misc_feature: GZ8MTXP02JVED4.39.40.D07.1.454.CMB.2.raw
  modified_base (208)..(208): a, c, t, g, unknown or other
  modified_base (218)..(218): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagatatcactggagaaatagtgatgacgcagtctccagcccaccctctctgtgtcctccaggagaaagngcccaccctntcctggtagggccagtcaggagtgttagctacaacttagcctggtaccagcagaaacctggccacggttcccaggctcatcatctagtggtgcactcccaccgacgggccctacgtcggtactccccgacgtacccccctaccgtttaggtcggtacgtaggggttcggggttcgttcgggggaacctaaggggtaacggtttccctaaccttaccttacccaacccaacttacccgaaacggacccgtaaacgggtcccccgttaggaccgtaacgggtttaccgttaagggtaaaaggtttactttttacgggaacgttttaaacggttttttaactttaacccggtttaggttaaaccctaaaacgttaacggttaaacctaaaggttcgtaaaccggttcgggtcccctttacgttacccgttaaccggttttccgggggacgggggtaaaccggggaaccggtaaaggggtcggaacgtaacgtaaaccgaaaacggtaacgtcgggtacgggtcctacggtaccctaacccgtagtttcccg

SEQ ID NO: 439567 - DNA, 575 bp, Homo sapiens
  misc_feature: GZ8MTXP02HMNY3.39.40.D07.1.454.CMB.2.raw
  modified_base (206)..(206): a, c, t, g, unknown or other
  modified_base (300)..(300): a, c, t, g, unknown or other
  modified_base (405)..(405): a, c, t, g, unknown or other
  modified_base (434)..(434): a, c, t, g, unknown or other
  modified_base (453)..(453): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccaccctctcctgcagggccagtcagtagtgttagcagctaacttagcctggtaccagcaagaaacctggccaggcctcccgaggcctcctnatctatgatcgccctcacccgagggcccagtcggtactccccgagcccccgtaggttcaggtcggactaaggttcgggtcgtggggaactagtagtttcactctnattatcagcagtcctgcctagtctagatntttagcttagtttattacngttcagtctaagtatactgacgtcggacttacggttcggaacgtaagggacccgtaagggtaacgaaacgtaacgaaaacgtacgtgtacggacttacggacctacgtacttcgtttaaccg

SEQ ID NO: 439568 - DNA, 542 bp, Homo sapiens
  misc_feature: GZ8MTXP02FNP9B.39.40.D07.1.454.CMB.2.raw
  modified_base (205)..(205): a, c, t, g, unknown or other
  modified_base (214)..(214): a, c, t, g, unknown or other
  modified_base (306)..(306): a, c, t, g, unknown or other
  modified_base (348)..(348): a, c, t, g, unknown or other
  modified_base (372)..(372): a, c, t, g, unknown or other
  modified_base (398)..(398): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccaggggaaangtcaccctncctgcagggccagtcagagtgttagcagcaacttagcctggtaccagcagaaacctggccagctccaggctctcatctatgatgcctcaccnggccatcggtatcccagccccagtcagtcggcaagtgggtcngggacagacgttcactcacgaccntcagcagccctagccagtctagagtntttagctagtttatactgtaccaagagtaacagtagtactggtaccctcgtactaccgtttcggggccggtaacgggtaccgtaaaggttcggaagtactaaccgaaacggtaacgtggttcgggactacggacctaccgtacg

SEQ ID NO: 439569 - DNA, 622 bp, Homo sapiens
  misc_feature: GZ8MTXP02IMY93.39.40.D07.1.454.CMB.2.raw
  modified_base (206)..(206): a, c, t, g, unknown or other
  modified_base (234)..(234): a, c, t, g, unknown or other
  modified_base (293)..(293): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctccgaggggaaangtccacctctcctgcagggccagtcagngtgtagcagcaacttagcctggtaccagcaagaaacctggccaggctcccaggctcctnatctatgactgccctacaccgaggggcccaacgtggtactccccagcccgaggttcagtggacaagttcgggtcgtgggacaggtacttcactctactattacacagccaggcccttgacctagtcctaagtagtatttaaggctttaggtttaacttgtaggtacagtacgtaagttaactaagtcggtaacttacgggtacccttaacggggtttccggaaccgtaaacgggggtaaccctaaaagggggttacggaaaacgttaacgaaaaaccgtaaaccggttgaccgggtacttacggacctacccgtagtttacctttccgg

SEQ ID NO: 439570 - DNA, 660 bp, Homo sapiens
  misc_feature: GZ8MTXP02I1LD1.39.40.D07.1.454.CMB.2.raw
  modified_base (204)..(204): a, c, t, g, unknown or other
  modified_base (213)..(213): a, c, t, g, unknown or other
  modified_base (217)..(217): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctcgaggggaangtcaccctntccngcagggccagtcagagtgtagcagctaacttgcctggtaccagcaagaaacctggaccaggcctcccgaggtcctcctcattctatgactcgccctccgacccgcggccctacgtcgtacctcccgagtccccgaggttccaggtcggtacaacggtttggggtccggtggggaaccgtacggtacgttcccacttcgttacttaaacgttatccgtaacggcctacgggtcccttagaccgttacgttaccgtaaggtaaacgtttagtttaacgtacgttttaaaggtttttactttagtacgtagtaacgtacgtaagtttaacgtagttaccgtacggttcggtaaccgtttacggtaccggaacggtaaacgggtaccgtaaaggtacgaaactaacggaaactcggtaagcgtctacgacctacgtcttactttccg

SEQ ID NO: 439571 - DNA, 582 bp, Homo sapiens
  misc_feature: GZ8MTXP02H7UOM.39.40.D07.1.454.CMB.2.raw
  modified_base (206)..(206): a, c, t, g, unknown or other
  modified_base (242)..(242): a, c, t, g, unknown or other
  modified_base (397)..(397): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccatggagaaatagtgatgacgcagtctccagccaccctgtctgtgtctccgaaggggaaangtccaccctctcctgcagggccagtcagagtgtagnagcaacttgcctggtacagcagaaacctggaccaggcctcccaggcctcctcatctatgatcgccctccacgagggccactggtacctccgacgcccctaggttccagtacggctaagttcgggtctaggggacaggtgttccactctacattancagcagcctgcagtctagactattacgcttaagtttactactgtatacgtcaagtaattaacgtcgaaccgttcggtaacccttacgggttaccgggacgaaaacggggaaaccgtaaaggggttaaacgaaacttaaccgaaacgtaacgtggtacggacgtacgacctaccgtaagttactcg

SEQ ID NO: 439572 - DNA, 730 bp, Homo sapiens
  misc_feature: GZ8MTXP02HO08X.39.40.D07.1.454.CMB.2.raw
  modified_base (207)..(207): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccaccctgtctgtgtctaccgaggggaaangtcaccctctcctgcgagggccagtcagagtgttagcagactaactagcctaggtaccagcaacgaaccgtcggaccaggccctaccccgaggtcccttaccctacgacttccgttaagtcgtaacgtcgcccctaccccgaacccggtacggggtcccaacggtttcggtaacctccccgaacggtcccccgaacgggtttccaaggtcggactaaggttcggggtccgtaggggactaggtacgtttccaacttcttaactatttactacgacgccgtaacgcccgtagtacgtaaggttaccgtaaggtaaagttacgtttaacgtacgtttaagtttttaactttacgtagttacctaaggtacttaaagtaactaacgtagtaccggttcggtacccgttaacgggttaccggaaccgggtaaacgggaaccggtaaaagggttaacgtaaaacgtaaccggtaaaacgtacggttaacggtacggtacgtacggactaacccgtagttccgtttaac

SEQ ID NO: 439573 - DNA, 554 bp, Homo sapiens
  misc_feature: GZ8MTXP02HS4PH.39.40.D07.1.454.CMB.2.raw
  modified_base (206)..(206): a, c, t, g, unknown or other
  modified_base (331)..(331): a, c, t, g, unknown or other
  modified_base (342)..(342): a, c, t, g, unknown or other
  modified_base (346)..(346): a, c, t, g, unknown or other
  modified_base (351)..(351): a, c, t, g, unknown or other
  modified_base (364)..(364): a, c, t, g, unknown or other
  modified_base (372)..(372): a, c, t, g, unknown or other
  modified_base (377)..(377): a, c, t, g, unknown or other
  modified_base (433)..(433): a, c, t, g, unknown or other
tcagtcgcactagtcacgaccggtgctcgatttagtgatagagcgtaacaacagagggggaggaactgctcagttaggacccagacggaaccatggaagccccagcgcagcttctcttcctcctgctactctggctcccagattccactggagaaatagtgatgacgcagtctccagccacctgtctgtgtctccgaaggggaaangtccacctctcctgcgagggccagtcagagtgtagcagcaacttgctaggtccagcagaacctggaccaggcctccgaggcctcctcgatcatgatcgcctccgacagggccagtggtacccganccccgagttcngtgntaagngggtctgggaacngtacgtcnctacncactacgcagcacgtcctgaccagtctagtacgtatttggtatttagttctgtacnggactagtataactactacggcctagtcgtcgtcgacggtttcggaacgtaacggtaaacgaacgtacgtaaaacgtaccgaaacgaaacgtcggttaacgcgtacggtaccacggtaccg

SEQ ID NO: 439574 - DNA, 530 bp, Homo sapiens
  misc_feature: GZ8MTXP01ALOBY.41.87.H10.1.454.CMB.2.raw
  modified_base (254)..(254): a, c, t, g, unknown or other
  modified_base (327)..(327): a, c, t, g, unknown or other
  modified_base (432)..(432): a, c, t, g, unknown or other
tcagtctatactatcacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccggcctccatctcctgcaagtccagtcagagccctcctacttggtgatggaaacngctattgactggtacctgcagagggcaggccagtctccacggctcctaatgtatgaggcttccgagacgggtntcgtggagtgcctaagatagattcagtggcagcgggtcggacaggagttcacactagaaaatcgaaggccgggtaggaggcgtggggaggagtgttggtagtttnttactgtatgtcagtggtatggcttcgtccgttccggtggtacgtttcgggcttaagggaaccaaggtaacggaaatcgaaacgtaacgttgtaacgg

SEQ ID NO: 439575 - DNA, 560 bp, Homo sapiens
  misc_feature: GZ8MTXP02JI32G.41.87.H10.1.454.CMB.2.raw
  modified_base (245)..(245): a, c, t, g, unknown or other
  modified_base (254)..(254): a, c, t, g, unknown or other
tcagtctatactatcacgaccggtgctcgatttagcagtactgcgttgggtttgggggatcaggacttctcagttcatcttctcaccatgaggctccctgctcagctcctggggctgctaatgctctggatccctggatccagtgcggatattgtgatgtcccagactccactctctctgtcagtcacccctggacagccggcctccatctcctgcaagtccagtcagacgcctcctacttggtnatggaaacngctatttgactggtacctgcaggaggcaggccagtctccacggctcctaatgtatgagcttcgagtacgggtctcgtggagtgccagtatagattcgaggtggcagggcggggtccggacgagagtacacgactagaaaactcgaaggccgggtaggaggcgtaggaggtagttaggttagggttagtttaagttacgtagttagtgtcgtagtggtagttcggtcgtcgtccgttcggtacggtacgtttacggaccgaagggaaccgtaaggtaacgaaacgtacgaaacgtaacgtggtacgg

SEQ ID NO: 439576 - DNA, 692 bp, Homo sapiens
  misc_feature: GZ8MTXP02I4N3Q.41.87.H10.1.454.CMB.2.raw
  modified_base (265)..(265): a, c, t, g, unknown or other
  modified_base (293)..(293): a, c, t, g, unknown or other
tcagtctatactatcacgaccggtgctcgatttagcagtactgcgttgggtttgggggatcaggacttctcagttcatcttctcaccatgaggctccctgctcagctcctggggctgctaatgctctggatccctggatccagtgcggatattgtgatcgtcccagacctccactctctctgtcagtccacccctggacagcccggcctccatcctcctgcaagtccagtcagacgcccttcctacgttggtagagtaggaaacngtcttatttgtactggtacctgacaggnggcacggcctagtcctccgaccggtcttacctaagtgtatcgtacggtccttaccgaggtaccggtctcgtgggacgtcgacgtagtactagtattcggaaggtcggacgtacgggtccgggggtaccggacgtacggtacgttaccgaacgtaacgttaacgtaaaacgtcggaacgggtccgggggtaggacggtcggtaggaggttagttagggtttagggttaacgttttaagttacgttaggttagttgtacgttaggtacggttacgttcggtaccgtttccggttacccgttacgggttacgggtttaccggtttacggggaaccgtaaaacgggtaaccgtaaaaggtaaacggtaaaacgtaacggtaaaacgtacggtacggttaacgg

SEQ ID NO: 439577 - DNA, 508 bp, Homo sapiens
  misc_feature: GZ8MTXP01DL2M5.4.27.C05.1.454.CMB.2.raw
  modified_base (176)..(176): a, c, t, g, unknown or other
  modified_base (277)..(277): a, c, t, g, unknown or other
  modified_base (474)..(474): a, c, t, g, unknown or other
  modified_base (502)..(502): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccacattacctgctctggaaatgaattggcagataagtttgtgtgtggtatcaagtgaggccaggccagtccctntttagcatgtatcgggatagaaagcggccctgagggatccctgacgccgcttctcgtggactacccaactcgtagggaaacacgagcccactctgacccatcacgcgggaccctaactttagatgagccgactattctgtcacacgtgggacagtggcactgcgtatcgtcggcggaagggccagcttgaccgtcgngggttcacgccaggctcgccccttgtcncgtccg

SEQ ID NO: 439578 - DNA, 535 bp, Homo sapiens
  misc_feature: GZ8MTXP01CM0SJ.4.27.C05.1.454.CMB.2.raw
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaaccattacctgctctaggaaatgaattggacagtattaagtttgtgtgttggtatcaagtgagccaggccagtcccctntttagcatgtatcggatagaagcgccctgaggatcccgtgacgcccgtcttcgtcgtggactacccaaactcgtagggaaacacgacgccactctagaccatcgacgcggaaccctaagtttagatcgacggccacttattctgtcacgaggtggacagtcggcagtgcgtatcgtcggcggaaggacaaggccttggacccgtcgttgggcacggcccaggcctccgccccgttacggtccaacgttcccg

SEQ ID NO: 439579 - DNA, 514 bp, Homo sapiens
  misc_feature: GZ8MTXP01BRZHA.4.27.C05.1.454.CMB.2.raw
  modified_base (278)..(278): a, c, t, g, unknown or other
  modified_base (469)..(469): a, c, t, g, unknown or other
  modified_base (478)..(478): a, c, t, g, unknown or other
  modified_base (508)..(508): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagtatagttgtgtgttggtatcaagtgaggcaggccagtcccctntttagcatgtatcggatagaagcggcctgaggatcccgtgacgccgtcttctcgtggactacccaactcgtagggaaaccacacgccactctagaccatcagcggacctaactttagatgacggctactattctgtcacgacggtggacagtgggcacgtgcgtatcgtcgggcggaacgggaccaagcgngaccgtcgngggttcacgccaggctcgccccttcggtcncgtccg

SEQ ID NO: 439580 - DNA, 525 bp, Homo sapiens
  misc_feature: GZ8MTXP01D1HN9.4.27.C05.1.454.CMB.2.raw
  modified_base (279)..(279): a, c, t, g, unknown or other
  modified_base (409)..(409): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcgggatagaaagcggccctcagggatccctgagcccgcttctctggactcccaaactctggggaaacacagcccactctgaccatcagcggaccaactttagatgaggcactatttcngtcacacgtgggacagtggcgactgcgatcgttcgcggaagggacgaacgcgttcgaccgtccgttcggttcgacgcccgaacggcgtcgccccgttcccggtccgaacgttcccg

SEQ ID NO: 439581 - DNA, 578 bp, Homo sapiens
  misc_feature: GZ8MTXP01EDQT2.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagcccaccattacctgctctaggaaatgaattggcagtataagttgtgtgttggtatcgaagtgaggccaggccagtcccctntttagcatgtatcgggataggaagcggcctgaggactcccgtgacgccgtctttcgtcgtggactacccaactcgtagggaaaccacacgccctactctacgaccatcgacggaccgggtaacctaacgtttagagtagacggccgtactattctgtacgacgtacggtcggacagtcggctacgtcgcgtagtccgttccgggcgggaacgggtaccgaaggtccgttcggaccgttccggttcgggttccacggcccgaggccgtccgccccgttcggtccgttccttcccg

SEQ ID NO: 439582 - DNA, 570 bp, Homo sapiens
  misc_feature: GZ8MTXP01EXBE8.4.27.C05.1.454.CMB.2.raw
  modified_base (280)..(280): a, c, t, g, unknown or other
  modified_base (311)..(311): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggccctnagggatccctgacgccgcttctctggactacccaactctgggaaacacagccactctgaccatcagccgggaccctagtttacgatgacggccgactatttctgtacacgtacgtgggactagtgggactaccgtgcgtattccgttcgggcgggaacgggaccaaaggtccttcggaacccggttcccgttcggggttccacggaaccccgaacggtccgttcccggccccccgttcgggttccgttaacttttcccg

SEQ ID NO: 439583 - DNA, 530 bp, Homo sapiens
  misc_feature: GZ8MTXP01CSRKL.4.27.C05.1.454.CMB.2.raw
  modified_base (278)..(278): a, c, t, g, unknown or other
  modified_base (310)..(310): a, c, t, g, unknown or other
  modified_base (524)..(524): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcgggatagaaagcggccctnagggactccctgagcccgctttctctggactacccaaactcgtaggggaaaccaacagcccaacgtctagacccatcagcgggaaccctaactttagatgacggccgacttattctgtcactacggtgggacagtgggcactgcgtatcgttcggcggaagggaccagcttgaccgtcttgggttcacgcccaaggcctcgccccttcggtccncgtccg

SEQ ID NO: 439584 - DNA, 621 bp, Homo sapiens
  misc_feature: GZ8MTXP01C3FKI.4.27.C05.1.454.CMB.2.raw
  modified_base (213)..(213): a, c, t, g, unknown or other
  modified_base (254)..(254): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctaggaaatgaattggcagataagttgtgtgttggtancaagtgaggccaggccagtcccctntttagcatgtatcggatagaagcgccctgaggatcccgtgacgccgtcttctctggactacccaaactcgtagggaaacacgacgccaactctacgacccatcgagaccgggacctaacgttttagattcggacgggtacccgaacttaacgtttccttagtacctaacgtaccggttaggggaccaagttcggggctaacgttacggcgtaacgtccggttacgggcgggtaacggggaaccgaaggccgttcggaacccggtccgttcgggggttaccaccgggccccgaaacgggtcccgttaccggcccccgttacggggtcccaaccgtttccccgg

SEQ ID NO: 439585 - DNA, 551 bp, Homo sapiens
  misc_feature: GZ8MTXP01AQHA6.4.27.C05.1.454.CMB.2.raw
  modified_base (278)..(278): a, c, t, g, unknown or other
  modified_base (308)..(308): a, c, t, g, unknown or other
  modified_base (542)..(542): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagataagttgtgtgttggtatcaagtgaggccaggccagtcccctntttagcatgtatcgggatagaagcgccctnaggatccctgacgccgtcttctctggactacccaactcgtaggggaaaccacacgccactctagacccatccacggccgggtaaccctaacttttagacttggacggccgtacttatttctgtacacgtacggtgggacagtgggcacgtcgcgtatcgtcggcgggaacgggaccgagcttcggaccggtcgcgggttccacggccccgaggccgtccgccccgttcggtccnccgttcccg

SEQ ID NO: 439586 - DNA, 623 bp, Homo sapiens
  misc_feature: GZ8MTXP01EA9HC.4.27.C05.1.454.CMB.2.raw
  modified_base (244)..(244): a, c, t, g, unknown or other
  modified_base (254)..(254): a, c, t, g, unknown or other
  modified_base (279)..(279): a, c, t, g, unknown or other
  modified_base (331)..(331): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagtatagttgngtgttggtancaagtgaggccaggccagtcccctntttagcatgtatcggatagaagcgcctcgaggactccctgacgccgtcttcncgtggactccaaactcgtagggaaaccacgacgcccactctacgacccatacgacgccgggaccctaacgttttagagtgacggaccgtacttatttactgttaccgacgtacggttgggacgtagtcgggactacgttcggcgtacgttccggttacggggccggggaaggggtaacccgaaaggtccgttacgggaaccccggttcccgttacgggggttccaccgggtaaccccgaaacgggtcccgtcccggtccccccgttccgggtcccttaacccgtttccccgg

SEQ ID NO: 439587 - DNA, 723 bp, Homo sapiens
  misc_feature: GZ8MTXP01D0FBB.4.27.C05.1.454.CMB.2.raw
  modified_base (214)..(214): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagtttgtgtgttggtatcaagtgaggccaggccagtcccctntttagcatgtatcggatagaagcggccctgagggactcccgtgacgccgcttctcgtggactcccaaactcgtaggggaaaccacgacgccctacgtctcgacccatcgacggaccggggtaacccctaaacgtttttaacggacgttacggaacgggtaccccgtaacttaacttttaccgttcggttaccgtaaccgttaaccggggttacgggggtaacctaaggttcgggggacccttaaccgtttcgggcccggtaacgtttcccggtttaccgggggacccggggtaaacgggggtaaccccgaaacgggtcccggttcgggtaaccccgggttcccgggttacgggggttcccgaaccgggtaacccccggaaacgggtccccgttcccgggtccccccccggttaccggggttccccttaaccccgtttccccgg

SEQ ID NO: 439588 - DNA, 637 bp, Homo sapiens
  misc_feature: GZ8MTXP01ERDGV.4.27.C05.1.454.CMB.2.raw
  modified_base (251)..(251): a, c, t, g, unknown or other
  modified_base (276)..(276): a, c, t, g, unknown or other
  modified_base (365)..(365): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagatagttgtgtgttgtancaagtgaggccaggccagtcccctntttagcatgtatcggatagaagcgcctgaggctccgtgacgcccgcttctctggactcccaactcgtagggaaaccacacgcctactcncgacccagtcgacgccgggtaacccctaagttttacgattcggacggtacccgtaacttactttcgtacggttaccgacgtaacggggttcggggacctaaggttcggggcctaacgtcggaccgtaagttccggttaccggggacgggaacggggaacccaaagggtcccgttacggtaaccccggttcaccgggggttccaaccgggtaacccccggaagggtccccttcccggcccccccgttacgggttaaccccttccgtttccccg

SEQ ID NO: 439589 - DNA, 541 bp, Homo sapiens
  misc_feature: GZ8MTXP01A6RSN.4.27.C05.1.454.CMB.2.raw
  modified_base (257)..(257): a, c, t, g, unknown or other
  modified_base (282)..(282): a, c, t, g, unknown or other
  modified_base (534)..(534): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagtttgtgtgttggtancaagtgaggccaggccagtcccctntttagcatgtatcgggatagaagcggccctcgagggactcccgtgacgtcccgtcttcgtcgtggactacccaaacttcgtagggaaaccacacgcccactctcgaccatcgacgccgggaaccctaacgtttagatgacgccgacttacttctgtcgacgacggtggacagtggcacgtgcgtatcgtcggcggaaggaccagcttcgaccgtcgttggttcacgcccgaggcctcgccccgttcggtccncgtcccg

SEQ ID NO: 439590 - DNA, 531 bp, Homo sapiens
  misc_feature: GZ8MTXP01CDKHC.4.27.C05.1.454.CMB.2.raw
  modified_base (252)..(252): a, c, t, g, unknown or other
  modified_base (277)..(277): a, c, t, g, unknown or other
  modified_base (523)..(523): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctgaaatgaattggcagataagtttgtgtgttggtancaagtgaggccaggccagtcccctntttagcatgtatcggatagaaagcggccctgaggactcccgtgacgcccgcttctctggactacccaactcgtagggaaacacagccactctacgaccatcagcggaccctaactttagatgacggccgacttattctgtcgacacggtgggacagtgggcacgtgcgtagtcgttcgggcggaacggccgaaggcttcggaccgtcgttggggttcacggcccaggcctcgccccgttcggtccncgttcccg

SEQ ID NO: 439591 - DNA, 540 bp, Homo sapiens
  misc_feature: GZ8MTXP01DL813.4.27.C05.1.454.CMB.2.raw
  modified_base (256)..(256): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctaggaaatgaattggacagataagtttgtgtgttggtancaagtgaggccaggccagtcccctctttagcatgtatcgggatagaaagcggcctcagggactccctgacgcggcctttctcgtggactacccaaactcgtaggggaaacaacacgcccaactctagaccatcagcggacctaactttagatgagcgactattctgtcacacggtggacagtggcacgtgcgtatcgtcgggcgggaacggacgaacgcgttcgacccgtcgttcgggttcgacgcccaaaggtccgtcgcccccgttcggtccgaacttcccg

SEQ ID NO: 439592 - DNA, 516 bp, Homo sapiens
  misc_feature: GZ8MTXP01EBDPC.4.27.C05.1.454.CMB.2.raw
  modified_base (213)..(213): a, c, t, g, unknown or other
  modified_base (243)..(243): a, c, t, g, unknown or other
  modified_base (275)..(275): a, c, t, g, unknown or other
  modified_base (508)..(508): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctgaaatgaattggcagataagtttgngtgttggtatcaagtgagcaggcagtcccctntttagcatgtatcggatagaaagcggcctgaggactccctgagcccgcttctctggactacccaaatcgtgggaaacacagccactctgaccatcagcggacctaacgtttagatgagcgactattctgtcgacacggtggacagtggcacgtgcgtatcgttcgggcggaagggaccaaggccgttcgaccgtccgttgggttccacgcccaaggcctcgccccttcggtcnccgttccg

SEQ ID NO: 439593 - DNA, 526 bp, Homo sapiens
  misc_feature: GZ8MTXP01EQMUR.4.27.C05.1.454.CMB.2.raw
  modified_base (279)..(279): a, c, t, g, unknown or other
  modified_base (519)..(519): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctnttttagcatgtatcgggatagaaagcggccctgagggatcccgtgagcccgcttctctggactcccaaactctggggaaacacagccactctgacccatcagcgggacccaacttttagatgaggccgactattctcgttcgacgacgtgggacagtcgggcactgcgtatcgttcgggcggtaagggccaagcttgaccgtccttgggttcacgcccaaggctcgccccgttcggtccncgtcccg

SEQ ID NO: 439594 - DNA, 633 bp, Homo sapiens
  misc_feature: GZ8MTXP01DXQIS.4.27.C05.1.454.CMB.2.raw
  modified_base (213)..(213): a, c, t, g, unknown or other
  modified_base (276)..(276): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctggaaatgaattggcagataagttgtgtgtggtatcaagtgagccaggccagtcccctntttagcatgtatcggatagaaagcgccctgaggactccgtgacgccgtcctttctcgtaggactacccaaacttcgtaggggaaaccacgacgcccactctacgacccatcgaacggccgggaaacccttaaacgttttagacgttacggacggtaccgtaactttaactttcgtcgttaccgaacgacgggttacggggaacctagttcggggacctaacgttcggccgtaagttccggttaccggggcgggaacggggaaccaaaggtccgttacggaacccggttcccgttagggggttcccacgggccccgaagggtccctacgggcccaccccgttcgggttccctaacccg

SEQ ID NO: 439595 - DNA, 536 bp, Homo sapiens
  misc_feature: GZ8MTXP01BU1CI.4.27.C05.1.454.CMB.2.raw
  modified_base (247)..(247): a, c, t, g, unknown or other
  modified_base (269)..(269): a, c, t, g, unknown or other
  modified_base (320)..(320): a, c, t, g, unknown or other
  modified_base (513)..(513): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtcccaggacagacagccacattacctgctctgaaatgaattggcagatagttgtgtgtgtancaagtgagcaggccagtccctntttagcatgtatcggatagaagcggcctgagggactcctgacgccgtcttntctggactacccaactcgtagggaaaccacacgcctactcgtagaccatacacgccgggaccctaacgtttacgatacggacggccgtaactattctcgtacgacgtacggtcggacacgtgggcacgtgcgtacgtcgttcggcggaagggaccaaggcgttcgaccgtccgttcgggttcacgccgagccncgtccccgttcggtccgcttccg

SEQ ID NO: 439596 - DNA, 500 bp, Homo sapiens
  misc_feature: GZ8MTXP01DSSOO.4.27.C05.1.454.CMB.2.raw
  modified_base (214)..(214): a, c, t, g, unknown or other
  modified_base (280)..(280): a, c, t, g, unknown or other
  modified_base (308)..(308): a, c, t, g, unknown or other
  modified_base (328)..(328): a, c, t, g, unknown or other
  modified_base (465)..(465): a, c, t, g, unknown or other
  modified_base (495)..(495): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagtttgtgtgttggtatcaagtgaggccaggccagtcccctntttagcatgtatcggatagaagcgcctnaggatccctgagccgcttcnctggactcccaaatctagggaaacacagccactctgaccatcagcggaccaactttagatgacgcgactattctgtcacacgtgggacagtgggcacgtcgcgtatcgtcggcggaagggacaggcttgaccgtcgngggttcagccaagctcgccccgttcggtcncgtcc

SEQ ID NO: 439597 - DNA, 570 bp, Homo sapiens
  misc_feature: GZ8MTXP01DWU85.4.27.C05.1.454.CMB.2.raw
  modified_base (214)..(214): a, c, t, g, unknown or other
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccctgcttactgcacaggatgcgtgacctcttatgagctgactcagccaccctcactgtccgtgtccccaggacagacagccaccattaccngctctggaaatgaattggcagtataagtttgtgtgttggtatcgaagtgaggccaggcctagtcccctntttagcatgtatcggatagaagcgcctgaggactcccgtgagcccgtcttctctcggactacccaaacgtcgtagggaaacaccgacgcccactctacgaccatcgacgacgggacctaacgtttacgagtgacggccacttcttactcgtacgacgtacggtagggactagtcgggcacgttgcgtagtcgttcgggcggaaggtaccgaagtccgttcggacccgtccgttcgggttcacggccccgaggccgtccgcccccgttacggtccttaaccgttcccg

SEQ ID NO: 439598 - DNA, 535 bp, Homo sapiens
  misc_feature: GZ8MTXP01EHUUM.4.27.C05.1.454.CMB.2.raw
  modified_base (213)..(213): a, c, t, g, unknown or other
  modified_base (217)..(217): a, c, t, g, unknown or other
  modified_base (273)..(273): a, c, t, g, unknown or other
  modified_base (419)..(419): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctntgaaatgaattggcagtataagttgtgtgttgatcaagtgagcaggccagtccctntttagcatgtatcggatagaagcggccctgagggactcccgtgacgtcccgtctttcgtcgtggacttacccaaacgttcgagggaaaccacacgccactctacgaccatcacgcggaaccctaatttagatgacggacatattcncgtcacgacggtgggacagtggcgacgtgcgtagtcgttcggcgggaacggacgaacgcgttcgtacgtcgttcggttcgacgccgacgcgtcgcccgttccgtcgttcgttcccg

SEQ ID NO: 439599 - DNA, 536 bp, Homo sapiens
  misc_feature: GZ8MTXP01C57MR.4.27.C05.1.454.CMB.2.raw
  modified_base (279)..(279): a, c, t, g, unknown or other
  modified_base (482)..(482): a, c, t, g, unknown or other
  modified_base (529)..(529): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagataagtttgtgtgttggtatcaagtgaggccaggccagtcccctnttttagcatgtatcgggatagaaagcggccctgagggactcccgtgacgcccgctttctctggactcccaaactcgtaggggaaaccacgagcccaactctcgaccatcagcgggaccctaactttagatgacggccgactatttctgtcacgacgtgggacagtgggcacgtgcgtatcgttcggcggaagggaccaagcgngaccgtcgttacgggttcacggcccaaggcctcggccccttcggtcncgttccg

SEQ ID NO: 439600 - DNA, 596 bp, Homo sapiens
  misc_feature: GZ8MTXP01CUNQT.4.27.C05.1.454.CMB.2.raw
  modified_base (253)..(253): a, c, t, g, unknown or other
  modified_base (275)..(275): a, c, t, g, unknown or other
  modified_base (332)..(332): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggacagataagttgtgtgtggtancaagtgagcaggccagtccctntttagcatgtatcgggataagaaagcggccctgagggactcccgtgacgccgcttcnctggaactccaaactcgtaggggaaacacacgcccactcagacccatacacggaccgggtaaccctaaaccgttttagattcggaacgggcccgtaacttaatttccgtacggttaccaacgaaccggttaggggacctaagttcggggacaacgttgccgtaagttcgttcgggacgggaacgggaacccaaaggcgttacggacccggtccttaggggccaacggccccaagggtcctcgcccccttggtcccaacttcccg

SEQ ID NO: 439601 - DNA, 565 bp, Homo sapiens
  misc_feature: GZ8MTXP01DQDXX.4.27.C05.1.454.CMB.2.raw
  modified_base (279)..(279): a, c, t, g, unknown or other
  modified_base (557)..(557): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagataagtttgtgtgttggtatcaagtgaggccaggccagtcccctntttagcatgtatcggatagaagcggccctgaggactccctgacgcccgtctttctcgtggaactcccaaacttcgtagggaaaccaaccgacgccccaactctacgaccctagtcacgccgggaaccctaacgttttaagacgttcgacggaccgtactactttctacgtcgacgtacggtaggacgagtgggcacgtagcgtatcgttcggcggaacgggacgaagcgttcgtaccgtccgttgggttcacgccacgccgtcgccccgttcggtccncgttcccg

SEQ ID NO: 439602 - DNA, 625 bp, Homo sapiens
  misc_feature: GZ8MTXP01A7KNX.4.27.C05.1.454.CMB.2.raw
  modified_base (214)..(214): a, c, t, g, unknown or other
  modified_base (252)..(253): a, c, t, g, unknown or other
  modified_base (278)..(278): a, c, t, g, unknown or other
  modified_base (322)..(322): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgccaccctcactgtccgtgtccccaggacagacagccacattaccngctcgtagaatgaatgacagtattagttgtgtgtgtannagtgacgcaggcctacgttcccttntttagctatgtagtacggataggaacgccgcctgaggtctccgngacgtcccgtcttcgtcgtcggactaacccgaacgtcggtacgggaaaccacgacgaccctactcgtacgaccacgtccgacgggacccggtaaccttaagtttacgacgttacggacggtacctacttacgtttcgtacgtacgtacggtacggtacggacgtacgtacggctacgtcgcggtacgttaccgggttcgggaacgggaacgggaaccacggtccgttacggtacccggtcggttacggttccgacgaacccggacgtcccgtcccggtccccgttcgtccgttccgtttcccg

SEQ ID NO: 439603 - DNA, 691 bp, Homo sapiens
  misc_feature: GZ8MTXP01C7X51.4.27.C05.1.454.CMB.2.raw
  modified_base (256)..(257): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtcccgtgtccccaggacagacagccacattacctgctctaggaaatgaattggacagtataagttgtgtgtggtannaagtgagcaggcacgtccctntttagcatgtatacgggaataggaagccggccctacgagggtactcccgtgacgtcccgtcctttctcgtacggtactaaccccaaacttccggtacgggaaacccaaccgaccgtaccctacctctacgaccctacgtaccgaacgggtacccgggtaacccttaaaccgttttaaggacgttacgggtaacgggtacccgttaacttacgtttacgttacgtacggtaaccgtacgggttagggacgtacggttcggggactacgtacggtccggtaacgttccggttaccggggaccggggtaacgggaacccgaacggtccgttacggtaccccggtccggttacggggttccaccggaaccccgtaacggcccgtccggcccccgttcggtcccttaaccgtttcccg

SEQ ID NO: 439604 - DNA, 742 bp, Homo sapiens
  misc_feature: GZ8MTXP01AK96W.4.27.C05.1.454.CMB.2.raw
  modified_base (259)..(259): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtccgtgtccccaggacagacagccaccattacctgctctaggaaatgaattggcagattaagtttgtgtgttggtancaagtgaggccaggccagtcccctntttagcatgtatcggatagaacgcgccctgaggactcccgtgacgcccgtcttctcgtaggactaacccgaaacgttccgtacggggaaaccacgacgtcccaacttcctacggaccctactaccgaacggtaccggggtaaacccctaaacgtttttaacggaacgttacgggaacgggtacccgttaacttaacgtttaccgttcggttaccggtaaccgtaaccgggttacgggggaacccgtaaggttcgggggacctaaccggttcggccggtaacgttcccggtttaccgggggacccggggtaacgggggtaacccgaaacgggtaccgttaccgggtaaccccgggttcccggttacgggggttcccgaacccgggaacccccggtaaacggggcccgttccccgggtcccccccggttaccgggtccccgttaaccccgtttcccccgg

SEQ ID NO: 439605 - DNA, 658 bp, Homo sapiens
  misc_feature: GZ8MTXP01CHT96.4.27.C05.1.454.CMB.2.raw
  modified_base (213)..(213): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctggaaatgaattggcagatagttgtgtgttggtatcaagtgaggccaggccagtcccctntttagctatgtatcggatagaaacgcggaccctcgaggactcccgtgacgcccgtcttcgtcgtcggtaactacccaaacgttccgtacgggaaaccacgacgacccaacgttcacgaccataccgacggaccgggtaacccttaaacgttttaagagttacggtacggaccgtaacttaacgtttcgtacgttacgtaacgtaccgggttagggaccgtaaggtcggggactacgtacggcggtaacgttccgttaccggggacggggtaaccggggaaccgaaacggtccgttacgggtaacccggttccggttacgggttccgaccggaacccgaacggtcccgtccgcccccgttcgggtccttaaccgtttccccg

SEQ ID NO: 439606 - DNA, 729 bp, Homo sapiens
  misc_feature: GZ8MTXP01CPKTV.4.27.C05.1.454.CMB.2.raw
  modified_base (213)..(213): a, c, t, g, unknown or other
  modified_base (281)..(281): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccacattaccngctctagaaatgaattggacagtataagtttgtgtgttggtatcaagtgaggccaggccagtcccctntttagcatgatcggatagaagcggccctgagggactcccgtgacgtcccgtcctttctcgtaggacttaaccccaaacttccgtaggggaaaccacgacgccctaacgtcctacgaacccataccgaacggtaccgggtaaacccctaaacgttttacgaacgttacggaacggtacccggtaacgttaactttccgttacggttaccctaaccggtaaccgggttacgggggaaaccgtaacggttcgggggaccctacggtttaccgggccgttaaacgttccgggtttacccggggcccgggggtaaacgggggtaaccccgaaacggtccggttaccggtaaccccgggtcccggttcgggggttacccgaccgggaaccccgaaacggggtcccttccccgggtcccccccgttcggggtaaccccttaacccgtttccccgg

SEQ ID NO: 439607 - DNA, 530 bp, Homo sapiens
  misc_feature: GZ8MTXP01AC88M.4.27.C05.1.454.CMB.2.raw
  modified_base (215)..(215): a, c, t, g, unknown or other
  modified_base (257)..(257): a, c, t, g, unknown or other
  modified_base (281)..(281): a, c, t, g, unknown or other
  modified_base (293)..(293): a, c, t, g, unknown or other
  modified_base (451)..(451): a, c, t, g, unknown or other
  modified_base (500)..(500): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattaccngctctaggaaatgaattggcagattaagttgtgtgttggtancaagtgagccatgccagtcccctntttagcatgtancggatagaaagcggcctgagggactcccgtgacgcgtcttcgtctggaactcccaactcgtacgggaaacacacgccacgtcacgaccatcgacggccgggtaaccctaacgtttagattgacggtccgtactactttcacggtcacgacgtgggacngtggcacgtgcgagtcgtcgggcggacgggaccagcgtcgaccgttcgngggttcaacgccgaagctcgcccctgctcc

SEQ ID NO: 439608 - DNA, 723 bp, Homo sapiens
  misc_feature: GZ8MTXP01BH6TI.4.27.C05.1.454.CMB.2.raw
  modified_base (214)..(214): a, c, t, g, unknown or other
  modified_base (281)..(281): a, c, t, g, unknown or other
  modified_base (327)..(327): a, c, t, g, unknown or other
  modified_base (375)..(375): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattgcagtatagttgtgtgtgtatcgaagtgaggccaggcctacgtccccttntttagctagtgtagtcggatagaagccggcctcgaggtactcccgngacgtccgtcttcgtcgtacggactaacccaacgttcgagggaaaccnccgacgacccacgttcacgtaccagtacgacggtaccgggtaacccttaaagttttacggaacgttacgggaacgggtacccgttaactttacgttttaccgtacggttaccgtaaaccggtacggggttacgggaaccgtaacggttccggggactaaccggttcggaccgttaacgttcccgggtttacgggggccggggtaaacggggaacccgaaacgggtccgttccgggtaaaccccgggtttcggttaccgggggttccgaaccccgggtaaccccggaacgggtccccggtaccccggttccccccggttaccgggttccccttaacccgtttcccccgg

SEQ ID NO: 439609 - DNA, 540 bp, Homo sapiens
  misc_feature: GZ8MTXP01AI1EY.4.27.C05.1.454.CMB.2.raw
  modified_base (279)..(279): a, c, t, g, unknown or other
  modified_base (487)..(487): a, c, t, g, unknown or other
  modified_base (497)..(497): a, c, t, g, unknown or other
  modified_base (504)..(504): a, c, t, g, unknown or other
  modified_base (532)..(532): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaagcggccctgagggactcccgtgacgcccgtcttctcgtggactacccaaactcgtagggaaaccacacgccactctacgacccatcgacgccgggaaccctaagtttacgatggacgccgtactatttctgtcgacacggtggactagtgggcacgtgcgtatcgtcgggcggaagggaccaaggcncgaccgtcgnggttccncgcccgaggcctccgccccgttcggtcnccgtcccg

SEQ ID NO: 439610 - DNA, 539 bp, Homo sapiens
  misc_feature: GZ8MTXP01BZJWM.4.27.C05.1.454.CMB.2.raw
  modified_base (280)..(280): a, c, t, g, unknown or other
  modified_base (533)..(533): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcgggatagaaagcggcctgagggatcccgtgacgccgcttctctggatcccaaactcgtgggaaaccacacgcccactctacgaccatcacgccgggaacccaacgttttagattagacggccgacttatttctgtcgacgtacgtgggacagtcgggcacgtgcgtatcgttcgggcggtaacgggaccaaggccttgacccgtcgttgggttcacgcccaggcctcgccccttcggtcncgtccg

SEQ ID NO: 439611 - DNA, 521 bp, Homo sapiens
  misc_feature: GZ8MTXP01EKILQ.4.27.C05.1.454.CMB.2.raw
  modified_base (279)..(279): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaagcggccctgaggactccctgagcccgcttctctggactcccaaactcgtaggggaaacacacgccactctgaccatcagcggacccaacttttagactgagcgactattctgtcacagtgaacagtgggcagtgcgatcgtcgggcggaagggaccaaggcttcggaccgtcgttggggttccagccccgaaggccgtcgccccgttggtccaacgtcccg

SEQ ID NO: 439612 - DNA, 698 bp, Homo sapiens
  misc_feature: GZ8MTXP01AITMS.4.27.C05.1.454.CMB.2.raw
  modified_base (258)..(258): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattacctgctctaggaaatgaattggcagtattaagtttgtgtgtggtancaagtgagccaggcctacgtcccctntttagctatgtatcggatagaagcggcctgaggactccgtgacgccgtcttctcgtggactacccaacgttcgtagggaaaccacgacgccactctacgaccatcgacggccgggtaaccctaacgttttagacgttacggaacggtacccgtaactttacgtttccgttacggtaccgtaacggtaaccggggttacggggtaaccgtacggttcgggggacctaaccggttcgggtaccgttaacggttcccgggttaccgggggccgggggaaacgggaaacccgttaacgggtccgttaccgggtaacccggttcccgggttacggggttcccgaccgggaaccccggtaacgggtccccgttcccgggtccccccgttcggggttaaccccttaacccgtttcccccgg

SEQ ID NO: 439613 - DNA, 641 bp, Homo sapiens
  misc_feature: GZ8MTXP01AB6HS.4.27.C05.1.454.CMB.2.raw
  modified_base (251)..(251): a, c, t, g, unknown or other
  modified_base (275)..(275): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagatagttgtgtgtggtancaagtgaggcaggccagtcccctntttagcatgtatcggatagaagcggccctgaggactccctgacgccgcttctcgtggactacccaactcgtaggggaaaccacacgcccaacttcacgaaccagtacacggaccgggtaacccctaaacgttttaacgaacttaggaaacggtcccgtacttaacgtttcctacgggttccaacgtaacgggttcgggaaccgtaagttcgggggcaaccgttggccgtaagtccgtttaccggggcgggtaacggggaacccaaaggcccgttagggtaaccccggttccggttcggggttccgacggaaccccgaaacgggccgttcccggccccccgttacgggtcccttcccggtttccccg

SEQ ID NO: 439614 - DNA, 705 bp, Homo sapiens
  misc_feature: GZ8MTXP01DKG7A.4.27.C05.1.454.CMB.2.raw
  modified_base (255)..(255): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagtataagtttgtgtgttggtancaagtgaggcaggccagtcccctntttagcatgtatcggatagaagcgcctgaggactccgtgacgtcccgtcttctctggactacccaactcgtagggaaaccacacgcccaactctacgacctagtaccgaacggtaccgggtaacccttaaacgttttaggaacgttacggaacgggtaccggtaacttaacttttccgttaggttaccgtaacgtaacggggttacgggaaccgtaacggttcggggacctacggttacggtaccggtaacgttccgggtttccggggaccggggtaaaccggggtaacccgaaacgggtcccgttaccgggtaaccccggtttcccggttacggggggttacccaccgggtaacccccgaaacggggtccccgttccccgggtaccccccccggtttacgggtccccgttaacccgtttccccgg

SEQ ID NO: 439615 - DNA, 553 bp, Homo sapiens
  misc_feature: GZ8MTXP01BGT10.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctggaaatgaattggcagataagtttgtgtgttggtatcaagtgaggccaggccagtcccctntttagcatgtatcggatagaagcgcctgaggactccgtgacgcctcttctctggactacccaactcgtagggaaacacgacgccactctagaacatcaggccggaaccctaacgtttagacgtgacggcctacttatttctagtcacgtacggtggacagtgggcacgtgcgtagtcgttcgggcggaacgggccaaaggtccttggtacccgtcggttggggttccacggccccgaaggcccgtccggcccccttggtaacccgttcgtcccg

SEQ ID NO: 439616 - DNA, 541 bp, Homo sapiens
  misc_feature: GZ8MTXP01ED2WK.4.27.C05.1.454.CMB.2.raw
  modified_base (245)..(245): a, c, t, g, unknown or other
  modified_base (255)..(255): a, c, t, g, unknown or other
  modified_base (280)..(280): a, c, t, g, unknown or other
  modified_base (308)..(308): a, c, t, g, unknown or other
  modified_base (316)..(316): a, c, t, g, unknown or other
  modified_base (467)..(467): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgngtgttggtancaagtgaggccaggccagtcccctntttagcatgtatcggatagaagcgcctnaggatccngacgccgtcttctctggactacccaactcgtagggaaacacacgcccactctacgaccatcacggccggacctaacgtttagatcgacggccgacttattctcgtacgacgacgttagggacagtgggacacgtcgcgtagtcgttcgggnggaacgggacaaggcttcggacccgtcgttcgggttcacgcccgaggctcggccccttcggtccttcgttcccg

SEQ ID NO: 439617 - DNA, 545 bp, Homo sapiens
  misc_feature: GZ8MTXP01A3TW4.4.27.C05.1.454.CMB.2.raw
  modified_base (213)..(213): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgccttagccatggcatggatccctctcttcctcggcgtccttgcttactgcacaggatgcgtgacctcttatgagctgactcagccaccctcactgtccgtgtccccaggacagacagccacattaccngctctaggaaatgaattggcagattaagtttgtgtgttggtatcaagtgaggccaggccagtcccctntttagcatgtatcgggatagaaagcggccctgagggatccctgagcgccttctctggatccaaaactctgggaacacagccactctgaccatcagcgggaccaactttagatgaggccgattattctgtcacgacgtgggacagtgggcacgtgcgtagtcgttcgggcgggaggaacccaaaggcctcggacccgtcgtggggttccgcggccccgaagggccctcggccccccttcgggttccctaaccgttccgttccccg

SEQ ID NO: 439618 - DNA, 711 bp, Homo sapiens
  misc_feature: GZ8MTXP01B2HEM.4.27.C05.1.454.CMB.2.raw
  modified_base (213)..(213): a, c, t, g, unknown or other
  modified_base (275)..(275): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctaggaaatgaattggcagtatagttgtgtgtgatcaagtgagcaggccacgtcccctntttagcatgtatcggaataggaagccggcctgaggactcccgtgacgcccgtcttcgtcgtggactacccgtaaactcgtacggggaaaccacgacgtacccactccgtacgacccataccggaaggacccggggtaaccccttaaacgtttttaagaacgttacgggaacgggtacccgtaacgttaacttttaccgttacgttaccggaaacgttaccggggttacgggaacgtaacggttccggggactaaccggttggacccggtaagttccgggtttaccggggaccggggtaacgggggaacccttaaacgggtccgttacggtaaccccgggttcgttaccgggggttaccgaacccgggtaacccggaacccgggtcccgttccccgggtccccccgttacgggtcccccgttaaccgttttcccccg

SEQ ID NO: 439619 - DNA, 664 bp, Homo sapiens
  misc_feature: GZ8MTXP01AT9BB.4.27.C05.1.454.CMB.2.raw
  modified_base (215)..(215): a, c, t, g, unknown or other
  modified_base (255)..(256): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattaccngctctaggaaatgaattggcagtatagttgtgtgtggtannaagtgagcaggccagtccccttntttagctatgtatcggatagaacgcggcctgaggtactccgtagcgtccgtctttcgcgtacggactaacccgtaacgtcgtacgggaaacaccgaacgtccctactcgtacgacccacgtaccgacggacccgggtaaacccttaacgttttaacgacgtacggacgggtaccctaactttaactttcgtacgtacgtaaccggtaacgggttacgggaaccgtaggtcggggtacctacggtcggtccgtaacgttccggttaccggggacgggaacgggaaccaacggtccgttacggaacccgttccggttacggggttccaccgggaaccccgtaggtcccgtcccggtcccccgttcgggtcccttaaccgtttccccg

SEQ ID NO: 439620 - DNA, 633 bp, Homo sapiens
  misc_feature: GZ8MTXP01BRLZ1.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttggtatcgaagtgaggccatgcctagtccccttntttagctatgtatcgggatagaacgcggcctgagggactcccgtgacgcgtcttctcgtggaactcccaacgtcgtacggggaacacgacgcccactctcgacctatacgacggaccgggtaaccctaacgttttacgagttacggacggccgtaacttacgtttcgtcgggttactaaccggtacggtcggggaacgtaacggtcgggacctaccgtggtccgtaacgttccggttccggggaacggggaacgggacccgaacggttccgtcggtacccggttccggttcgggttaccgaaccggacccgaacggcccgtccgcccccgttcggttcccgttaacccg

SEQ ID NO: 439621 - DNA, 749 bp, Homo sapiens
  misc_feature: GZ8MTXP01B22RL.4.27.C05.1.454.CMB.2.raw
  modified_base (152)..(152): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagcccacctcactgtccgtgtccccaggacagacacgccacattacctgctactaggaaatgaattggactagtattaagtttgtgtgtggtatacgaagtgacgccaggcctacgtccccttatttagcagtgtatcgggataggaacgcggccctagagggactcccgtgacgtccgtcttacgtcgtacggaacttacccgaaacgttcggtacggggaaaaccaccggtaacgacccctaacttaccgtaccggtaaaccccaacgttaccggtaaaccgggaccccggggttaaaaccccctttaaacgtttttaaaggacgttacggaaaccgggtacccgtaacctttaagtttccgtacggttaccaacgtaccggggttaggaaccgtaggttcggggacctacgttcgggcgtaacggttccggttaccggggacgggtaaacgggaacccgaacggtcgttacccgggtaacccggtttccggttcgggggttacccaaccgggccccgaaacggggtccccgttaccccgggccccccggtttcgggttaaccccgttcccgtttccccgg

SEQ ID NO: 439622 - DNA, 625 bp, Homo sapiens
  misc_feature: GZ8MTXP01BF855.4.27.C05.1.454.CMB.2.raw
  modified_base (251)..(252): a, c, t, g, unknown or other
  modified_base (273)..(273): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattacctgctctaggaaatgaattggacagtatagttgtgtgtgannagtgagcaggccagtcccctntttagcatgtatcggatagaagcgcctgaggactccgtgacgccgtcttcgcgtggactacccaactcgtagggaaaccacgacgcccactctacgaccagtaccgacggacccgggtaaacccttaagttttaacgagttacggaacggtacccgtaacttacgtttacgtacgttaccgaacgtacgggttacgggaaccgtaggttcgggacacgttacggacgtacgttccgttccggggaccggaagggaacccgaaggtccgttcggtacccgtccgttgggttccaccggtaacccgaacgggtcccttacccggcccccgttcggtcccttaaccgtttccccg

SEQ ID NO: 439623 - DNA, 581 bp, Homo sapiens
  misc_feature: GZ8MTXP01BFC4N.4.27.C05.1.454.CMB.2.raw
  modified_base (255)..(255): a, c, t, g, unknown or other
  modified_base (280)..(280): a, c, t, g, unknown or other
  modified_base (573)..(573): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtancaagtgaggccaggccagtcccctntttagcatgtatcgggatagaagcggccctcgagggactccctgacgcccgtctttctcgtggactacccaactcgtaggggaaacacacgcccactctacgaccatcgacggaccggggaccctaacgttttacgattacgacgggcccgtacttatttctcggtcacgtacggttggggaccagtgggccacgtggccgtagtccgttcgggcgggaacgggaccaaggccgttagacccggtccgttaggggttccacggccccagggcctcggcccccgttcgggtccncgttcccg

SEQ ID NO: 439624 - DNA, 626 bp, Homo sapiens
  misc_feature: GZ8MTXP01C4R7V.4.27.C05.1.454.CMB.2.raw
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattacctgctctaggaaatgaatggacagtataagttgtgtgttgtatgaagtgaggcagcctacgtccctntttagcatgtagtcggaatagaagtcggccctagaggactccgtgacgtccgtcttctcgtaggactaaccctaacgtcgtagggaaaccacgacgccaactcgtacgaccaactcgacggtaccgggtaaccctaaagttttagacgttcggaacggtaccgtaacttacgtttacgtcgtaccgtaacgtacgggttcggggaacctagtcggggacctacgtcggacgtagttccggtcgggaccgggaagggaaccgaaggtcgttcggacccggtcgttacggggttccacggaaccccgaagggtcccttccggcccccgttgggtcccttaaccgtttcccg

SEQ ID NO: 439625 - DNA, 546 bp, Homo sapiens
  misc_feature: GZ8MTXP01DDOOU.4.27.C05.1.454.CMB.2.raw
  modified_base (213)..(213): a, c, t, g, unknown or other
  modified_base (252)..(252): a, c, t, g, unknown or other
  modified_base (277)..(277): a, c, t, g, unknown or other
  modified_base (411)..(411): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctggaaatgaattggcagatagttgtgtgttggtancaagtgaggccaggccagtcccctntttagcatgtatcggatagaagcggccctgagggactcccgtgacgccgctttctcgtggactacccaaactcgtagggaaaccacagcccactctagaccatcacgcggaccctaatttagatgagccgactnttctgtcgacgacggtgggacagtgggcacgtgcgtagtccgtcgggcggaagggaccaaggccgttcgacccgtcgttcggggttccacggcccgaaggccgttccggcccccgttcggtcccaaccgttcccg

SEQ ID NO: 439626 - DNA, 712 bp, Homo sapiens
  misc_feature: GZ8MTXP01C7URG.4.27.C05.1.454.CMB.2.raw
  modified_base (215)..(215): a, c, t, g, unknown or other
  modified_base (286)..(286): a, c, t, g, unknown or other
  modified_base (339)..(339): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgccaccctcactgtcccgtgtccccaggacagacagccacattaccngctctaggaaatgaattggacagtataagttgtgtgttgtatcaaggtgaggccaggcctacgttcccttntttagctatgtagtcggggtaataggaacgccggtcctacgaggtactcccgngacgtccgcttacgtgtggactaacccgaacgtcgtacgggaaccacgacgcctactcgacgacacgtacgacggaccggtaaccttaaacgtttaggacttacggaacgggtaccgttaacgttacttttacgtacgttacgtaaccggtaacgggttacggggaacctaagggttcggaccgtacgttacgggacgttaacgttccgggttaccggggaacggggaaacggggaacccgttaaacgggtcccgttaccgggtaacccggttcccggggttacgggttacccgaaccgggaaccccgtaaacggggttccccttccccgggtacccccgttcccgggttaacccttaacccggtttcccccg

SEQ ID NO: 439627 - DNA, 689 bp, Homo sapiens
  misc_feature: GZ8MTXP01ELKM3.4.27.C05.1.454.CMB.2.raw
  modified_base (259)..(259): a, c, t, g, unknown or other
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggacagtataagtttgtgtgttggtancaagtgagccaggccagtcccctntttagcatgtatcggatagaagccgcctgagggactcccgtgacgtcccgtctttcgtcgtcggacttaacccaacgttcgtaggggaaaccacgacgcccacgtcgtacgacccatacgacggtaccgggtaaccctaacgttttaagacgttaggacggtacccgtacttaactttcgtacggtacctaacgtacgggttacggggaacctaaggttcgggactaacgtcggtaccgtagttccggttccggggacgggtaacgggaaccccgaaagggtcccgttaacgggtaccccgggttcccggttcgggggttcccgaaccgggtaacccccggaaacggggtccccgttcccgggtcccccccggttaccgggttccccgttaacccttttcccccgg

SEQ ID NO: 439628 - DNA, 616 bp, Homo sapiens
  misc_feature: GZ8MTXP01ERA7W.4.27.C05.1.454.CMB.2.raw
  modified_base (152)..(152): a, c, t, g, unknown or other
  modified_base (216)..(216): a, c, t, g, unknown or other
  modified_base (257)..(257): a, c, t, g, unknown or other
  modified_base (284)..(284): a, c, t, g, unknown or other
  modified_base (344)..(344): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagcccaccctcactgtccgtgtccccaggacagacagccacctattaccngctctaggaaatgaattggacagtataagttgtgtgtgtancaagtgagccaggcctacgtccccttntttagcagtgtagtcgggaatacgaagccggcctagaggtactccgtgacgccgtcttcncgtggactaccaacgtcgtagggaaaccacgacgccactcgtacgacctataccgaacggaccggtaaccccttaaagttttagacgttaggacgtaccgtacttaactttcgtcgttacgacgtacggtaggacagtcgggcacgtcgacgtacttccggtacgggacgggaacgggaccgttaaaggtccgttacggacccgttcggttcggggttccaccggtaacccgacggtcctcccggcccccgttcggtccttaaccgttcccg

SEQ ID NO: 439629 - DNA, 659 bp, Homo sapiens
  misc_feature: GZ8MTXP01BA6RZ.4.27.C05.1.454.CMB.2.raw
  modified_base (213)..(213): a, c, t, g, unknown or other
  modified_base (217)..(217): a, c, t, g, unknown or other
  modified_base (245)..(245): a, c, t, g, unknown or other
  modified_base (255)..(255): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctntaggaaatgaattggcagataagtttgngtgttggtancaagtgaggccaggccagttcccctntttagtcatgtatcgggataggaaagcggaccctcgagggactcccgtgacgcccgctttctcgtggtactaccgaaactcgtagggaaacacgacgccactctacgaccataccgaggacccggggtaaccctaaagttttaacggacgttacggaacgggtcccgtaacttaactttcgttacgtcgaacgtacggttaggggacctagtcggggactacgtcggtcggtacgttccggttccggggcggggtaacgggaacccgaaagggtccgttacggtaaccccgggttcgttcgggggttcccaccgggaacccccgtaacgggtcccgttcccggtccccccggttcgggtcccttaacccgtttccccg

SEQ ID NO: 439630 - DNA, 696 bp, Homo sapiens
  misc_feature: GZ8MTXP01AT3B4.4.27.C05.1.454.CMB.2.raw
  modified_base (266)..(267): a, c, t, g, unknown or other
  modified_base (291)..(291): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccttcttatgagctgactcagcccaccctcactgtccgtgtccccaggacagacacgccaaccattacctgcttcgtaggaaatgaattggctaagtattaaggtttgtgtgttgtannaagtgagcaggccacgtccccttntttagcatgtatcggataggaaagccggccctcgagggactcccgtgacgtcccgtcctttcgtcgtcgggacttaacccaaacgtcgtacggggaaaccacgacgtccctaacctcgtacgacccagttaccgaacggtacccggggtaacccttaaacgttttaacgagttcgggaacgtacccgtaacttacgtttcctcgtacgtaacgtacggggttagggaaccgtaggtcggggacctaacggttcggacggttacgtccggttccggggaccggggaaacgggaacccgttaaaggtcccgttacggggtaaccccggttccggttacggggttccaccggaaccccggacggtccccgtccggcccccccgttcggtcccttaacccgtttccccg

SEQ ID NO: 439631 - DNA, 698 bp, Homo sapiens
  misc_feature: GZ8MTXP01CHY29.4.27.C05.1.454.CMB.2.raw
  modified_base (256)..(256): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtccgtgtccccaggacagacagccactattacctgctctaggaaatgaattggcagtatagttgtgtgttgtancgagtgaggcaggcctacgtcccttatttagctatgtagtcgggtaataacggaaacgccggccctacgacgggtactcccgtggacgtccccgtccttcgtcgtaggtacctaacccgaacgttcggtacggggaaacccaccgtacggacccctacttccgaccgaacctacgtaccgaacgggtaccgggtaaacccttaacgttttaagacgtacggacgtacccgtactttaacgtttcgtcgtacggtaacgtacgggtacgggaactaggttcgggacctacgtacggcggtacgttccggggttcgggaaccgggaacgggaaccgacgggtcccgttacggtaccccggttcggttaccgggttccgaaccggaaccccgaacggtccccgtccccggtcccccgttccggtcccgttaacccgtttccccgg

SEQ ID NO: 439632 - DNA, 567 bp, Homo sapiens
  misc_feature: GZ8MTXP01ENZA4.4.27.C05.1.454.CMB.2.raw
  modified_base (255)..(255): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattacctgctctggaaatgaattggcagataagttgtgtgttggtancaagtgaggcaggccagtcccctntttagcatgtatcgggatagaaagcggcctcgagggactcccgtgacgccgcttctctggacttacccaaactcgtaggggaaaccacacgccacgtctagacccatcagcgggacctaacgttttagatgacggccgactattctcgtcactacggtggacgagtcgggctacgtgcgtagtcgttcgggcggaacgggaccgaaaggccgttcggaccggttcccgttggggttccacggccccaagggcccgtcggcccccgttcggtcccgttaaccgttcccg

SEQ ID NO: 439633 - DNA, 630 bp, Homo sapiens
  misc_feature: GZ8MTXP01B8AR2.4.27.C05.1.454.CMB.2.raw
  modified_base (215)..(215): a, c, t, g, unknown or other
  modified_base (255)..(255): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacctattaccngctcgtaggaaatgaattggcagtatagttgtgtgtgtancagtgagcaggcacgtcccctntttagcatgtatcggatagaagccggcctcgagggactcccgtggacgtccgtcttcgtcgtaggtacctaaccaacttcgagggaaccacgacgccaactcacgacctagtcacggaccgggtaacccttaacgttttagacgtacggacggtcccgtaatttacgttctacgtacgaacgtacggttacgggaccgtagtcggggctacgttcggcgtacgttccggttcggggcgggtaacgggaaccgttaacggccgttacggacccggttcccggttggggttccaccggtcccggaacgggtcccgtccccggtccccgttccgggtaacccttcccgtttccccg

SEQ ID NO: 439634 - DNA, 619 bp, Homo sapiens
  misc_feature: GZ8MTXP01BKO9Q.4.27.C05.1.454.CMB.2.raw
  modified_base (261)..(261): a, c, t, g, unknown or other
  modified_base (288)..(288): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacagccaaccattacctgctcgtaggaaatgaattggcagtataagtttgtgtgttggtancaagtgaggccaggcccagtccccttntttagcatgtatcgggatagaacgccggcctgaggactcccgtgacgcctcttctcgtggactacccaactcgtgggaaaccacgacgccactctacgaccataccgacggaccgggtaacccttaacgttttagacgttacggacggtaccgtaacttatttacgtcgtaccgacgtaacggttgggaacgtagtcgggactacgtgccgtacgtccgttcggggacgggaacgggaaccgaaaggtccgttacggtacccggtccgcggggttccaccggtcccgaacgggtcccgtccggcccccgttcgggtccttaaccgttcccg

SEQ ID NO: 439635 - DNA, 654 bp, Homo sapiens
  misc_feature: GZ8MTXP01DUTAQ.4.27.C05.1.454.CMB.2.raw
  modified_base (214)..(214): a, c, t, g, unknown or other
  modified_base (283)..(283): a, c, t, g, unknown or other
  modified_base (464)..(464): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccacattaccngctctaggaaatgaattggctagtataagttgtgtgttggtatcgaagtgaggccaggccagtcccctntttagcatgtatcggatagaaagccgggcctcgagggactcccgtggacgtcccggtcttcgtctgggacctaaccctaaacgtcgtacggggaaaccaccgacgcccaactctacgacccatcgaacggaccgggaacccttaaacgttttagagttacgacgggtcctacttactttcncgttacgaacgtacggttacggaccgaagtcggggactacgtcggtacgtacgttccgtccggggacgggaacggggaacccgaaaggccgttacggaacccggttccgttcgggggttccaaccgggtccccgaaacgggtccctccccgggtcccccccgttacggtccccttaacccgtttccccgg

SEQ ID NO: 439636 - DNA, 643 bp, Homo sapiens
  misc_feature: GZ8MTXP01ERXWJ.4.27.C05.1.454.CMB.2.raw
  modified_base (248)..(248): a, c, t, g, unknown or other
  modified_base (256)..(256): a, c, t, g, unknown or other
  modified_base (281)..(281): a, c, t, g, unknown or other
  modified_base (342)..(342): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctcgtaggaaatgaattggacagattagttgngtgtgtangagtgagcaggcctacgtccccttntttagcatgtatcggatagaacgccgtcctgacggtactcccgtagacgtcccgtctttcncgtaggtactacccaaagttccgagggaaaccacgacgaccctactcgtacgaccatcgaacggacggaaccctaagtttagagtacgacggaccttacttatttcgtgtaaccgtacgtacgggttaggaccaaggttcggggactacgtcggtacgtagttccggtacgggacgggtaacggaaccgttaaggtccgttacggtacccggtttaccggttcggggttccaaccgggaaccccggaaaggtccccgttccccgggacccccggttcgggtaacccttcccggttccccgg

SEQ ID NO: 439637 - DNA, 563 bp, Homo sapiens
  misc_feature: GZ8MTXP01DL92V.4.27.C05.1.454.CMB.2.raw
  modified_base (213)..(213): a, c, t, g, unknown or other
  modified_base (255)..(255): a, c, t, g, unknown or other
  modified_base (279)..(279): a, c, t, g, unknown or other
  modified_base (319)..(319): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctggaaatgaattggcagtataagtttgtgtgttggtancaagtgaggccaggccagtccctnttttagcatgtatcggatagaagcggcctgaggactcccngacgccgctttctcgtcggactcccaaactcgtacggggaaaccacgacgcccactctacgaccatcgacgcgggacctaactttagactgacggccgactatttctgtcgacgacggtggacagtcgggcacgtcgcgtagtcgttcgggcgggaacgggaccgaaggcgttcgtaccggtccgttcgggttccacggcccgaaaggcccgttccggcccccgttcggtccaaccgtttcccg

SEQ ID NO: 439638 - DNA, 546 bp, Homo sapiens
  misc_feature: GZ8MTXP01EIDPJ.4.27.C05.1.454.CMB.2.raw
  modified_base (283)..(283): a, c, t, g, unknown or other
  modified_base (504)..(504): a, c, t, g, unknown or other
  modified_base (538)..(538): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagtataagtttgtgtgttggtatcaagtgaggccaggccagtcccctntttagcatgtatcgggatagaaagcggccctgagggactcccgtgacgccgctttctcgtggactacccaaactcgtagggaaaccacagcccactctagaccatcacggccgggaaccctaacttttagatgacggccgtacttatttctgtcgacgacggtgggacagtgggcacgtgcgtatcgttcgggcgggaagggaccaagcttggaccgtcgngggttcacgcccaggcctccgccccttcggtccncgttcccg

SEQ ID NO: 439639 - DNA, 523 bp, Homo sapiens
  misc_feature: GZ8MTXP01BQ99D.4.27.C05.1.454.CMB.2.raw
  modified_base (244)..(244): a, c, t, g, unknown or other
  modified_base (252)..(252): a, c, t, g, unknown or other
  modified_base (275)..(275): a, c, t, g, unknown or other
  modified_base (468)..(468): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgngtgtgtancaagtgagcaggccagtcccctntttagcatgtatcggaatagaagcgcctgaggactccctgagccgcttctcgtggactcccaactcgtgggaaacacagcccactcgtgaccatcgacgcgggacctaactttacgagtagacggcgactattctgtcacgacgtggacgagtcgggcacgtgcgtagtcgttcgggcgggaagggaccagcncgtaccgtcgttcgggttcacggccacggcctccgccccgttcggtccgctcccg

SEQ ID NO: 439640 - DNA, 616 bp, Homo sapiens
  misc_feature: GZ8MTXP01AJMZG.4.27.C05.1.454.CMB.2.raw
  modified_base (215)..(215): a, c, t, g, unknown or other
  modified_base (282)..(282): a, c, t, g, unknown or other
  modified_base (335)..(335): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattaccngctctaggaaatgaattggcagtataagttgtgtgttgtatcaagtgaggcacggccacgtcccctntttagctatgtatcggatagaacgcgcctgaggtactcctgacgccgtcttcncgtcggatacccaactcgtacgggaaaccacgacgccactctacgaacccataccgacggaccgggtaaccctaacgttttacgagttacggacggacccgtacttaacgtttctacgtacgaacgtacggtgggaccaggtcggaccacgtcggcgtacgttccggttccgggccggggaacgggaaaccgaacggtccgttacggtaacccggtccggttcgggttccgacggaacccgacggtccgtcccgccccgttacgggtcccaacgttccccg

SEQ ID NO: 439641 - DNA, 673 bp, Homo sapiens
  misc_feature: GZ8MTXP01CV75N.4.27.C05.1.454.CMB.2.raw
  modified_base (253)..(254): a, c, t, g, unknown or other
  modified_base (276)..(276): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggacagataagttgtgtgtgtannagtgagcaggccagtccccttntttagctatgtagtacgggataggaaacgcggaccctgagggactcccgtgacgtcccgtcttcgtcgtaggactaacccgaactcgtacggggaaaccacgacgccaactcacgaccagtaccgacggaccgggtaaccctaagttttacgacgtaggacggtaccgtaacttacttccgtacgtacgtaaccgtaccggggttagggaaccgtagttacgggcaacgttcggaccggttaacgtcccggttccgggacggggtaacggggtaccccgaaaggtcccgttaccgggaacccggttcccggttcgggggttacccaccgggtaaccccgaacgggtccccgttcccggcccccccggttcgggtaacccgttaacccgtttccccgg

SEQ ID NO: 439642 - DNA, 604 bp, Homo sapiens
  misc_feature: GZ8MTXP01A93ZC.4.27.C05.1.454.CMB.2.raw
  modified_base (215)..(215): a, c, t, g, unknown or other
  modified_base (248)..(248): a, c, t, g, unknown or other
  modified_base (255)..(255): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattaccngctcgtaggaaatgaattggcagtatagtttgngtgtgancaagtgagcaggcctacgtccccttntttagctatgtatcgggataggaacgccggccctgagggtactcccgtgacgcccgtcttctcgtacggactacccaactcgtacgggaaaccacgacgtcccacttcgtacgaaccctagtaccgacggtaccgggtaacccttaagtttaacgagtacgacgggacctacttactttacgtcgtacgacgtacggtggacgagtcggcacgtcgcgtagtcgtacgggcggaacggacgacgtcgttcggtacccggtcgttacggttcgaccggtaacccgaggtccgtccggccccgttacggtccttaaccgttcccg

SEQ ID NO: 439643 - DNA, 594 bp, Homo sapiens
  misc_feature: GZ8MTXP01AYA10.4.27.C05.1.454.CMB.2.raw
  modified_base (213)..(213): a, c, t, g, unknown or other
  modified_base (252)..(252): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctaggaatgaattggcagataagttgtgtgtggtancaagtgaggccagtgcctagttccccttntttagctatgtagtcgggataggaacgcggcctgaggatcccgtgacgcgcttctcgtggaactccaacgttcgagggaaaccacgagcccaacttcgtcgaaccagtccgaggaccgggtaaccctaaacgtttagacgtgacggtaccgtacttactttcgtacggtcaacggtacggtcgggacctagtcggggcctaacgttcggcgtacgttccgtcggggaacggacgggacgtaacgccgtcggacccgttccgttgggttccaaccggcccgaacggcccgtccgcccccgtcggccctaacccg

SEQ ID NO: 439644 - DNA, 661 bp, Homo sapiens
  misc_feature: GZ8MTXP01ARWXM.4.27.C05.1.454.CMB.2.raw
  modified_base (217)..(217): a, c, t, g, unknown or other
  modified_base (255)..(255): a, c, t, g, unknown or other
  modified_base (375)..(375): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacacgccacctattaccngctctaggaaatgaattggcagtatagttgtgtgtgancaagtgagccaggccacgtccccttatttagcagtgtagcgggaataggaacgcccggcctagaggactcccgtgacgtccgtcttgtcgtggactacccgaatcgtagggaaacctacncgtccactctacgacccagtccgaacggtccgggtaaacccttaagtttacggacgttacggaaccgggtacccgttacttaacgttttcgtacggtaccgtaacggtaccggggttacggggaacctagggttcggggacctacggtcgggtacgtacggtcgggttacggggacggggaacgggtaaccaacggtccgttaccggtacccgggtccgttcggggccaccggaacccgacgggttccccgtccgtcccccggttcggtccttaacccgttccccg

SEQ ID NO: 439645 - DNA, 608 bp, Homo sapiens
  misc_feature: GZ8MTXP01D50DX.4.27.C05.1.454.CMB.2.raw
  modified_base (153)..(153): a, c, t, g, unknown or other
  modified_base (215)..(215): a, c, t, g, unknown or other
  modified_base (259)..(260): a, c, t, g, unknown or other
  modified_base (283)..(283): a, c, t, g, unknown or other
  modified_base (326)..(326): a, c, t, g, unknown or other
  modified_base (337)..(337): a, c, t, g, unknown or other
tcagagcactgtagcacgaccggtgctcgatttagacgcgatcgaagggtttggggctgggcctcaggaagcagcatcgggaggtgcctcagccatggcatggatccctctcttcctcggcgtccttgcttactgcacaggatgcgtgacctnttatgagctgactcagcccaccctcactgtccgtgtccccaggacagacagccacattaccngctactaggaaatgaattggacagtataagtttgtgtgtggtannaagtgagcaggtcacgtcccctntttagcatgtatcggaatagaaagcggcctgagggactcccgngacgcctcttntcgtcgactaaccactcgacggaacacgacgcctactacacgacatacgacggtaccggtaaccttaagtttagacgtacggacggtaccgttacttacttcgtacgtaccggtaacggtacgggtacgggacgtaggtcggacgtacgtcggaccgtacgttccggtacggggacgggaacggaacgagtccgttaccggtaccgtcggttacgggccaccggaacccgacggtcccgtcccggtccccgttacggtccttccgttcccg

SEQ ID NO: 439646 - DNA, 710 bp, Homo sapiens
  misc_feature: GZ8MTXP01BSHSZ.4.27.C05.1.454.CMB.2.raw
  modified_base (152)..(152): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagccaccctcactgtccgtgtccccaggacagacagccaccattacctgctctaggaaatgaattggcaagtataagtttgtgtgttcggtatcaagtgaggccgacggcctaccgttccccttatttagctagtgtacgtacgggtaataaggaacggcccggtaccctacggacgggtaccttccgtaggaccgtcccgtctttcgcgtaggactaaccctaaacgtcggtacggaaacacgacgacctactcgtacgaccataccgacggtacccgggtaaccttaagtttacgacgttacggacgggtaccttacttactttcgtacggtactaacggtacggggtacggaaccttagggcgggaacctagttcggcgtaacgttttccgggacgggggaacgggtaaccgggaacgttaacgggtccggttaccggtaaccccggttcgggttccgggggttcaaccccggggtaacccggaccgggtccgttcccccgggcccccggttccgggttaacccttcccgggttttccccg

SEQ ID NO: 439647 - DNA, 686 bp, Homo sapiens
  misc_feature: GZ8MTXP01APGP7.4.27.C05.1.454.CMB.2.raw
  modified_base (216)..(216): a, c, t, g, unknown or other
  modified_base (294)..(294): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactcgtccgtgtccccaggacagacagccaccattaccngctctaggaaatgaattggacagtattaagtttgtggttgttggtatcgaagtgacggccacggcctacgtccccttntttagctagtgtagtcgggataggaacgccggccctcgagggtactcccgtgacgtcccgtcttcgtcgtggactacccaacgtcgtacgggaaaccacgacgccctactctacgaccacgtaccgacggacccgggtaacccttaaacgtttaggacgttacggacggtaccgttacttacgtttcttcggtaccgaccgtacgggtacgggaacgtaggtcggggtaccaaccgtcggccggtacgttacccggttaccggggacggggtaacggggaacccgaacgggtccgttcgggtaccccgttccgggttcgggttccgaccgggaaccccggtaacgggcccggtccccggtcccccgttccgggtaacccgttccgttccccg

SEQ ID NO: 439648 - DNA, 634 bp, Homo sapiens
  misc_feature: GZ8MTXP01CM3LQ.4.27.C05.1.454.CMB.2.raw
  modified_base (214)..(214): a, c, t, g, unknown or other
  modified_base (256)..(257): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacctattaccngctctaggaaatgaattggacagtattagttgtgtgttgtannaagtgagcagccacgtccctntttagctatgtagtcgggaataggaaacgccgggtaccctagagggactcccgtggacgtcccgtcttcgtcgtcggactacccaactcgtagggaaacacgacgccactctacgacctagtacgacggacccgggtaaccctaaacgttttaacgacgttacggaacggtacccgttaacttagtttaccgtacggttaccgaacgtaccgggttagggaccttaggttcggacctacgtacggcgtaacgttccggttacgggacgggaacgggaaccagggtcttcggtaccgtcgttcgggccacggcccgacggtccgtcccggccccgttcggtccttaaccgtttcccg

SEQ ID NO: 439649 - DNA, 715 bp, Homo sapiens
  misc_feature: GZ8MTXP01CRP16.4.27.C05.1.454.CMB.2.raw
  modified_base (257)..(258): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtcccgtcgtccccaggacagacacgccacattacctgctgtaggaaatgaatgacagattagttgtgtgtgtannaagtgagcaggccacgtcccttntttagcatgtatacgggatacggaacgccgcctgaggtactcccgtgacgtcccgtcttcgtcgtaggactaacccgaacgtcgtacgggaaaccctacgacgacccctacgttactacgaaccctagtaccggaacgggaccgggtaaaccccttaaagttttaacgaagtacggtaaccggtaccgttaacgtttacgtttaccgttacggttaccgtaacggtaacggggtacgggtaacgtacggttacggggacctaacggttcggaccggtacgtttaccgggtccggggaacggggaacgggtaaaccccgaagggttccgaccggtaccccgggttccgggttacgggttcccgacccggtaaccccgaaccgggttccccgtccccggtacccccggttccggtaacccgttcccgtttccccgg

SEQ ID NO: 439650 - DNA, 528 bp, Homo sapiens
  misc_feature: GZ8MTXP01C740X.4.27.C05.1.454.CMB.2.raw
  modified_base (253)..(253): a, c, t, g, unknown or other
  modified_base (277)..(277): a, c, t, g, unknown or other
  modified_base (521)..(521): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattacctgctctaggaaatgaattggcagataagttgtgtgttggtancaagtgagccaggccagtcccctntttagcatgtatcggatagaagcgcctgaggactcccgtgacgccgtcttctcgtggactcccaaactcgtagggaaaccacgacgcccactcgacgaccatcgacgacgggtacctaactttagatagacgcgtactattctacgtcacgtacggtggacagtcggcacgtgcgtatcgtcggcgggaacggacgaacgcttcgaccgtcgcgggttcacgccaggcctcgcccgttcgtccncgttccg

SEQ ID NO: 439651 - DNA, 611 bp, Homo sapiens
  misc_feature: GZ8MTXP01DTSXX.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctctaggaaatgaattggacagtataagtttgtgtgttggtatcaagtgagccaggccagtcccctntttagcatgtatcggatagaagcgcctgaggactccgtgacgccgtcttctcgtaggactacccaatcgtagggaaacacacgccactctacgaccatcgacggccggtaacctaaacgtttagacttacggacggtcctaacttacttcgtagtaccgacgtacggtgggacgtaggtcgggacacgttacggccgtacgttccggttccgggacgggaacggaaccgaaggtccgttaccggacccggttcggttacggggttccaccgggaacccgaacgggtcccgttcccggtcccccgttcgggttcccttaaccgtttccccg

SEQ ID NO: 439652 - DNA, 658 bp, Homo sapiens
  misc_feature: GZ8MTXP01DPT48.4.27.C05.1.454.CMB.2.raw
  modified_base (152)..(152): a, c, t, g, unknown or other
  modified_base (255)..(255): a, c, t, g, unknown or other
  modified_base (280)..(280): a, c, t, g, unknown or other
  modified_base (335)..(335): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagccaccctcactgtccgtgtccccaggacagacagccacattacctgctctaggaaatgaattggacagtattaagttgtgtgtgtancaagtgaggccaggcctagtccctntttagcatgtatcggatagaagcgcctgaggactcccgtgacgtcccgctttacncgtggactacccaaacgttcgacgggaaaccacgacgccctaactctacgaccataccgaacgaccggggtaaccccttaagttttaagagtacggacggtaccgtacttaacttccgttacgtaccgaacgtacgggttacgggaaccctaggtacggggtcctacggtacggcgtacgttccggttaccggggacggggaacgggaaccccgaaaggtcccgttacgggtacccggttccggttacgggttacccgaccgggtccccgaacgggtccccgtcccggtcccccgttccgggttaacccttcccgtttccccg

SEQ ID NO: 439653 - DNA, 685 bp, Homo sapiens
  misc_feature: GZ8MTXP01A4SRR.4.27.C05.1.454.CMB.2.raw
  modified_base (216)..(216): a, c, t, g, unknown or other
  modified_base (220)..(220): a, c, t, g, unknown or other
  modified_base (235)..(235): a, c, t, g, unknown or other
  modified_base (253)..(254): a, c, t, g, unknown or other
  modified_base (262)..(262): a, c, t, g, unknown or other
  modified_base (273)..(273): a, c, t, g, unknown or other
  modified_base (311)..(311): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtccgtcgtccccaggacagacagccacattaccngctntagaaatgaattggnagtatagttgtgtgtgannagtgagcngcacgtccctntttagcatgtatcggatagaagccgcctgaggctccgngacgcccgtcttctcgtcggactacccgtaacgtcgtagggaaaccacgacgccctaacgtctacgacctactccgaacggtaccgggaaccccttaaacgttttaacggaacgttacggaacggtacccggtaactttacgtttacgttaccgtaccgtaaacgtaccggggttacggggaaccgtaacggtcgggggacctacggttacgggtaccgtaacgttccgggttaccgggccggggtaaacggggaacccgaaacggtccgttaccggtacccggttcccggttcgggttcccgaaccggtaaccccggtaacggtcccgttcccggccccccggttccgggtaacccttaacccgtttcccccg

SEQ ID NO: 439654 - DNA, 664 bp, Homo sapiens
  misc_feature: GZ8MTXP01CLSGV.4.27.C05.1.454.CMB.2.raw
  modified_base (238)..(238): a, c, t, g, unknown or other
  modified_base (249)..(249): a, c, t, g, unknown or other
  modified_base (254)..(254): a, c, t, g, unknown or other
  modified_base (256)..(256): a, c, t, g, unknown or other
  modified_base (260)..(260): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgttccttgcttactgcacaggatgcgtgacctcttatgagctgactcacgcccacctcactcgtcccgtcgtacccaggacagacacgccactattacctgctagagaaatgaatganagtatagttgngtgtnangagncgcagcctacgttcccttgtttanctatagtagtacggtaaatacggaacgtcccggtacccagggacggtacctccgtaggacgtccccgttcttacgtcgtacggacctaaccctaaacgttcgaacgggaaacctacacccgcctaacgttcacgaccctagacccggaacggtacccggtaaaccctttaaggttaagacgtacggaccggtaccttacttacttacgtacgaccggtaacgtacgggtacgaccgtaggtccggactacgtcgacgtacgtcgggtacggacgggaacgtacaggtccgttaccggtaaccggtcggttaccgggaccaccgggaacccgaacgttccccgtcccggtacccccgttcgtcccgttaaccctttccccg

SEQ ID NO: 439655 - DNA, 650 bp, Homo sapiens
  misc_feature: GZ8MTXP01A2WBX.4.27.C05.1.454.CMB.2.raw
  modified_base (212)..(212): a, c, t, g, unknown or other
  modified_base (250)..(250): a, c, t, g, unknown or other
  modified_base (274)..(274): a, c, t, g, unknown or other
  modified_base (643)..(643): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattaccngctctaggaaatgaattggcagatagttgtgtgttgancaagtgagcaggccagtccccttntttagcatgtatcgggaatagaaagccggccctgacgggtactcccgtggacgtcccgtccttcgtcgtacggacttacccgaaacgttcgtacggggaaaccacgacggtaccctaactccgttacgaacccctagttacccgaacgggtacccggggttaaacccctaaaccggttttttaacgaaggttacggaaacggggtaccgtaacttaactttcgtacggttaccgacgtaacgggtcgggacctaggttcgggactacgtacggcgtaagtccggttcggggcgggtaacgggacccgttaaaggccgttggacccgtcgcgggttcacggcccgaagccctcgccccgttcggtaaccncgttccg

SEQ ID NO: 439656 - DNA, 722 bp, Homo sapiens
  misc_feature: GZ8MTXP01BZ0T2.4.27.C05.1.454.CMB.2.raw
  modified_base (216)..(216): a, c, t, g, unknown or other
  modified_base (261)..(261): a, c, t, g, unknown or other
  modified_base (288)..(288): a, c, t, g, unknown or other
  modified_base (330)..(330): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacagccaccattaccngcttacgtaggaaatgaattggactagtatagtttgtgtgtgtancgagtgacgccaggcctacgtcccttntttagctatgtatcggaataggaagccgcctgaggactccgngacgtccgtcttcgtcgtggacctacccaaacgtccgtaagggaaacccacgaccgtaccctactcgtacgaccctataccgaacgggaccggtaacccttaaagttttacgacgttcggaacggtacccgtacttacgtttacgtcgtaccgtaacgtacgggttacgggaccgtaaggtcggggtacctacggttacgggaccgttacggttcccggttaaccgggggaccggggtaaacggggtaaacccgttaaacgggtccccggttacgggtaacccccgggttttcccgggaccggggttacccgaacccgggtaaccccgaaccggggttccccttaccccgggtccccccgttccgggtaacccttaaccccgtttcccccgg

SEQ ID NO: 439657 - DNA, 577 bp, Homo sapiens
  misc_feature: GZ8MTXP01A4SJU.4.27.C05.1.454.CMB.2.raw
  modified_base (287)..(287): a, c, t, g, unknown or other
  modified_base (456)..(456): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccatcctcactcgtccgtcgtccccaggacagacacgccaccattacctgctcgtaggaaatgaattggcagtattagttgtgtgtggtatcaagtgaggccaggcctacgtccccttntttacgctagtgtatcgggataaggaacgccggtccctcgagggactcccgtggaccgtcgtcttctcgtggaactcccgtaactcgagggaaccacgacgccactcacgaccagtcgacgccgggtaaccctaacgtttacgagtggacggtccgtacttactttacnggtaccacgtacggtacggactagtcgggacacgtgcgtagtccggtcgggcgggacggacacgcgtcggacccgttcgttgggccaacggcccaaggccctcgccccgtcggttctcccg

SEQ ID NO: 439658 - DNA, 721 bp, Homo sapiens
  misc_feature: GZ8MTXP01APGU6.4.27.C05.1.454.CMB.2.raw
  modified_base (214)..(214): a, c, t, g, unknown or other
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagtttgtgtgttggtatcgaagtgaggccaggccagtcccctntttagcatgtatcggatagaagcggccctgaggactcccgtgacgcccgtctttctcgtcggacttaacccaaacgttcgtacggggaaaccacgaacgccctaactccgtacgaccctaatccgaacggacccggggtaacccttaaacgttttaagaacgttcgggaacggtacccggttacttaacgtttcgtacgtaccgtaacgaccgggttacggggaactacggtcggggaccacggttacggccggtaacgttccggtttacccgggggacggggtaaccggggaacccgttaaacggggtcccgttaccgggtaaccccgggttcccggttaccggggggttacccacccggggtaaccccggaaacgggtcccggttccccggtcccccccggtttacccggggtaacccgttccccggtttcccccgg

SEQ ID NO: 439659 - DNA, 680 bp, Homo sapiens
  misc_feature: GZ8MTXP01CQZ5K.4.27.C05.1.454.CMB.2.raw
  modified_base (272)..(272): a, c, t, g, unknown or other
  modified_base (289)..(289): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcatgacctcttatgagctgactcacgcccaccctcactcgtccgtcgtccccaggacagacacgccacctattacctgctcgtaggaaatgattggacagattagttgtgtgttggatcgagtgagccnggcctacgttccccttntttacgctagtgtagtcgggaataaggaaacggccggacccgtagacggggtactcccgtggaccgtccggtactttcgtacgtcggaaaccttacccgaacgttcggtaacgggaaaccacgaccgtaccctacgtccgtacgaaccctacgtacccggaacggtacccggggtaaaccccttaaagtttttacggaacgttacgggaacggttacccgttaactttacgttttccgtacgggtaccgtaacggtacgggttacgggacgtagtcgggactacgtggtccgtagttccggtcgggaacggtaacggaccgtacgcgtacggtccgttacggttcgggttccaacgtaccgaacggccgtccgccccgtcggttcctcccg

SEQ ID NO: 439660 - DNA, 682 bp, Homo sapiens
  misc_feature: GZ8MTXP01BQBDV.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgccttagccatggcatggatccctctcttcctcggcgtccttgcttactgcacaggatgcgtgacctcttatgagctgactcagccaccctcactgtcccgtgtccccaggacagacagccacattacctgctctaggaaatgaattggcaagtattaagttgtgtgttggtatcaagtgaggccaggccacgtcccctntttagtcatgtagtcgggatagaagcggccctgacgggatcccgtgagcgtccttctcgtcggactacccgaaaactcgtcgggaaacacgtacgcccactctcgaccagtacgacggaccgggtaacccttaaacgttttaggaacgttacgggacggtacccgtaacgttactttcgttacgtaccgaacgggtaacgggttgggggaacctagggttcggggacctacgtcggtaccgtacgttccggtttaccgggggacggggtaacggggaacccgtaaacggttccggtaccggacccggttaccgggtacggggttacccgttacggaccccggtaacgggtcccgtcccggtcccccggtcgggttaccctccgttcccgtttcccccg

SEQ ID NO: 439661 - DNA, 671 bp, Homo sapiens
  misc_feature: GZ8MTXP01BQQBB.4.27.C05.1.454.CMB.2.raw
  modified_base (258)..(258): a, c, t, g, unknown or other
  modified_base (288)..(288): a, c, t, g, unknown or other
  modified_base (336)..(336): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagacagccacattacctgctctaggaaatgaattggcagtattaagttgtgtgtgtancaagtgaggccagggcccacgttccccttntttagctatgtatcgggaataaggaagccggccctgagggactcccgngacgccgtctttctcgtggactacccaacgtcgtacgggaaacacgacgcctactctcgaccataccgaggaccgggtaaccctaaacgttttacgacttcggaaccggtaccgtacgttactttcgttacggtaccgaacggtacggggtacgggtaacgtaggtcggggacctacggtcggtacggtacgttccggttaccgggggccgggaacgggggaacccaaacgggtccgttcggtaaccccggttccggttcggggttaccgaccggaacccggtaaccgggccgttacccggcccccgttccgggtcccttaacccgtttccccgg

SEQ ID NO: 439662 - DNA, 630 bp, Homo sapiens
  misc_feature: GZ8MTXP01EXUQ5.4.27.C05.1.454.CMB.2.raw
  modified_base (283)..(283): a, c, t, g, unknown or other
  modified_base (368)..(368): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtattaagttgtgtgttggtatcaagtgaggccaggcctagtcccctntttagctatgtatcggatagaagccggcctgaggatcccgtgacgccgtcttcgtcgtggactacccaactcgtagggaaccacncgaccactctagaccatcgacggaccggaaccctaagttttacgagttcggacggtacccgtacttactttcgtacgtacgtaacgtacggttcggggaaacgtggtacggggccctacgtcgtacgtaacgttccggttacggggcggggaacgggaccttaaacgggccgttacggtacccggttccgttccgggttcgaccggaaccccgacgggccctcccgggtcccccgttacgggttccgttaaccctttccccg

SEQ ID NO: 439663 - DNA, 680 bp, Homo sapiens
  misc_feature: GZ8MTXP01BZAOG.4.27.C05.1.454.CMB.2.raw
  modified_base (254)..(255): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagtatagttgtgtgtgtannagtgagcaggccacgtcccttntttagctatgtatcggatagaagccgcctgaggctccgtgcgccgtcttcgtcgtcggactacccaacgtcgtacgggaaacctacgacgccctaacgtcctacgacccagtaccgacgggaccgggtaaccccttaaagttttaacggacttacgggacggtacccgttaactttcgtttacgtcgttaccggaaacgtacggggttacggggacctaggttcgggggactaccggtcggtaccggtacgttccggttcgggggaccgggaacggggtaaccccaagggtccgttaccggtacccgggttcccggttcggggttcccgacccggtaaccccgggtacgggtccccgttccccggtccccccgttaccgggtcccttaaccccgtttccccgg

SEQ ID NO: 439664 - DNA, 688 bp, Homo sapiens
  misc_feature: GZ8MTXP01BX5E9.4.27.C05.1.454.CMB.2.raw
  modified_base (286)..(286): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccacctattacctgctctaggaaatgaattggcagtataagttgtgtgttggtatcaagtgacggccaggccacgtccccttntttagctatgtagtcgggataaggaaacgccggccctagacgggtactccccgtgacgtcccgtctttctcgtggtactacccaacgttcgtacgggaaaccacgacgccctactcgtacgaacccagtccgacggtaccggtaacccctaagttttaacggacgtggtacgggacccgttactttactttaccgtcggttaccacggtacgggttgggaccgtagtcggggactacgtcggccgtacgttccggttaccggggccgggtaacgggaacccgttaacggtcccggttacggtaaccccggttcccggttacggggttcccgttaacccggccccgaaccgggtcccgttacccgtcccccccggttacgggtccccttaacccgtttccccg

SEQ ID NO: 439665 - DNA, 606 bp, Homo sapiens
  misc_feature: GZ8MTXP01BH5QA.4.27.C05.1.454.CMB.2.raw
  modified_base (214)..(214): a, c, t, g, unknown or other
  modified_base (257)..(257): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtattaagttgtgtgttggtancaagtgagcaggccagtcccctntttagcatgtatcgggatagaagccgcctgaggtactcctgacgccgtcttcgtcgtggtactacccaacgtcgtacgggaaaccacgacgcctactctcgaccagtacgacgtaccgggtaaccttaacgtttaagacgttacggacggaccgtacttactttcgtcgtacgacgtacgggtcggacgtagtgggctacgtcgcgtacgttccggttcggggcgggaacgggaccgaacggtccgttacggtacccggtcggttcgggggccacgggcccgaacggtcccgtccggcccccgttcggtccttaacccgtttcccg

SEQ ID NO: 439666 - DNA, 710 bp, Homo sapiens
  misc_feature: GZ8MTXP01AL0W0.4.27.C05.1.454.CMB.2.raw
  modified_base (257)..(257): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagtataagttgtgtgttggtancaagtgagccaggccagtcccctntttagcatgtatcggatagaagcgcctcgaggctcccgtgacgtcccgtcttctcgtacggactacccgaaacgtcgtacggggaaaccacgacgccctaacgtctacgaacccataccgacggaccgggtaacccctaaagttttacgacgttaggacggtacccgtaacttaactttcgtacgtaccgtaacgtaacgggttacgggaaccgtaaggttcggggaccgtaacccgttggaccggttaaccgttaccggtttccgggggaaccgggtaaccggggtaaacccgaaacggtccggttaccgggtaaaccccggttcccggttacgggggttacccgttaacgggaaccccccggaaacgggtccccgttaccccgggcccccccgtttccggggttccccttaacccgttttcccccgg

SEQ ID NO: 439667 - DNA, 638 bp, Homo sapiens
  misc_feature: GZ8MTXP01AXKVQ.4.27.C05.1.454.CMB.2.raw
  modified_base (260)..(260): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtcccgtgtccccaggacagacacgccactattacctgctacgtaggaaatgaattggactagtatagttgtgtgtgancgaagtgagcaggccagtcccctntttagcatgtatcggatagaacgccgcctagaggactccgagacgtcccgtcttcgtcgtaggactaacccaacgttccgtagggaaaccacgacgtccctactcgtacgaccctagtaccgacggtaccggtaacccttaaagttttacgagtacggacgggtccttaactttacgtttccgtacgttaccgacgtacgggttacggactacggtcgggacctacgtagcgtacgttccggtacgggcgggaacggtaccaggtccgttccggtaccgttccggttacgggttccacggaaccccgtacggcccgttcccggccccgttccggttccttaacccgtttccccg

SEQ ID NO: 439668 - DNA, 650 bp, Homo sapiens
  misc_feature: GZ8MTXP01CBMDE.4.27.C05.1.454.CMB.2.raw
  modified_base (257)..(257): a, c, t, g, unknown or other
  modified_base (286)..(286): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggacagtatagttgtgttgttgtancaagtgaggccaggcctacgttccccttntttagcatgtagtacgggataggaacgccgccctgacgggtactcccgtgacgtcccgtcttctcgtacggactaaccctaaaccgtcggtaacgggaaacctaccgacgaccctactcacgaccactacgaacggaccgggtaaccctaacgttttacgacgttacgacggtaccgtacttacgtttacgtacgtacgtacgtacgggtacggtaacgtagtacgggacctacgtcgcggtacgtacggttccgggacgggaacgggaccgaacggtccgttcggtacccgtcggttacgggttccgaccggaacccgacggtcccgtcccggtccccgttccggtccgttaaccgttccccg

SEQ ID NO: 439669 - DNA, 623 bp, Homo sapiens
  misc_feature: GZ8MTXP01CDZLT.4.27.C05.1.454.CMB.2.raw
  modified_base (251)..(252): a, c, t, g, unknown or other
  modified_base (273)..(273): a, c, t, g, unknown or other
  modified_base (285)..(285): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtgtccccaggacagacagccacattacctgctctaggaaatgaattggcagtatagttgtgtgtgannaagtgagcaggccagtccctntttagcatgtancggatagaagcgcctgaggtactccgtgacgtcccgtcttctcgtgactacccaaacgttcgacgggaaaccacgacgccctaacgttcgacgaaccctacgtaccgaacggacccgggtaaacccttaaacgttttaacgacgttacggacgggtacctacttaactttcgtacgtaccgaacgtacggtggactagtcgggctacgttgcgtacgttccggtcgggcgggaacgggaaccgaacggtccgttacggtaacccgttccggttacggttccgaccggcccgaacggtcccgtacccggtcccccgttcggtccttaacccgtttcccg

SEQ ID NO: 439670 - DNA, 666 bp, Homo sapiens
  misc_feature: GZ8MTXP01AOULJ.4.27.C05.1.454.CMB.2.raw
  modified_base (254)..(254): a, c, t, g, unknown or other
  modified_base (280)..(280): a, c, t, g, unknown or other
  modified_base (320)..(320): a, c, t, g, unknown or other
  modified_base (367)..(367): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtatagttgtgtgtggtancaagtgagccaggccacgtccccttntttagcatgtatcgggatagaacgcgcctgaggactccgngacgtcccgtcttcgtcgtggacttaccaacgtcgtacgggaaaccncgacgcctactctacgaccagtccgaacgggtaccgggtaaccccttaacgttttaacgacgtacgggacggtcccgtaactttacgtttcgtacgtaccgtacgtacgggtacgggacgtacggttggggacctaacgttcggtcggtaacgtttccggttaccgggggacggggtaaccgggaaccgttaaacgggtccgttacgggtaccccggttccggttcggggttacccgaccggaaccccggtaagggtcccctcccggtcccccgttcgggtcccttaaccgtttccccg

SEQ ID NO: 439671 - DNA, 693 bp, Homo sapiens
  misc_feature: GZ8MTXP01CB9SK.4.27.C05.1.454.CMB.2.raw
  modified_base (152)..(152): a, c, t, g, unknown or other
  modified_base (213)..(213): a, c, t, g, unknown or other
  modified_base (253)..(253): a, c, t, g, unknown or other
  modified_base (276)..(276): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagccaccctcactgtccgtgtccccaggacagacagccacattaccngctctaggaaatgaattggcagtatagttgtgtgtggtancaagtgagccaggccagtccctntttagcatgtatcggatagaagcgcctagaggactcccgtgacgtcccgtctttctcgtggaactacccgaaacttcgtacggggaaaccaccgaacgcccctaactccgtacgaaccctaagttaccgaacgggtacccgggtaaaccccttaacgtttttaaacggacgttacgggaaccggtacccgttaacttacgtttaccgtacggttaccgtaaccgtaacggggttacgggtaacgtaggttccgggggacctacggttacgggtacccgtaacgttccggttaccgggggccgggaacggggtacccgaaacgggtccgttacggtaaccccggtccggttcggggttccgacgggtccccgaacggcccgttcccggcccccgttcggtaacccttccgtttccccg

SEQ ID NO: 439672 - DNA, 640 bp, Homo sapiens
  misc_feature: GZ8MTXP01DXX5N.4.27.C05.1.454.CMB.2.raw
  modified_base (133)..(133): a, c, t, g, unknown or other
  modified_base (253)..(253): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttacngcacaggatgcgtgacctcttatgagctgactcagccaccctcactgtccgtgtccccaggacagacagccacattacctgctctagaaatgaattggacagtatagttgtgtgtggtancaagtgagcaggcctacgtcccttntttagcatgtactcggaatagaagccgcctgaggactccgtgacgtccgtcttactcgtggacctaacccaaacttcgacgggaaaccacgacgcccactctacgacctactacgacggaccggtaaccttaaacgttttaagacgttacggacggtaccgtacttactttacgttacgtaccgtaacggtacggttaacggggaaccgtacggttcggggacctacgttacgcgtacgttccggttcgggcgggaaacgggacgaaacggtccgttacggtacccggttccggttacgggttccgaccggaacccggaacgcccgtcccggccccgttcggtcccgttaaccgtttccccg

SEQ ID NO: 439673 - DNA, 705 bp, Homo sapiens
  misc_feature: GZ8MTXP01BQD8M.4.27.C05.1.454.CMB.2.raw
  modified_base (217)..(217): a, c, t, g, unknown or other
  modified_base (260)..(260): a, c, t, g, unknown or other
  modified_base (285)..(285): a, c, t, g, unknown or other
  modified_base (326)..(326): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactcgtccgtgtccccaggacagacacgccaccattaccngctacgtaggaaatgaattggacagtattagttgtgtgtgtancaagtgagcaggccacgttcccttntttagcatgtatcggataggaacgcggcctgaggctcccgngcgcccgtcttcgtcgtggacttaacccgaacttcggtacgggaaaccacgacgtccctaactcgtacgaccctacgtaccgaacggacccgggtaacccttaacgttttaacggacgtacggtaacgggtaccgttacgttacgtttacgtacggttaccgtaacggttaccggggtacgggaacgtaggttaccgggccgttaacggtcggtaccgtcgttacccgggttcggggccggggtaaacgggacccgttaaacgggtccgttaccgggtaacccgggttccggttacgggggttcccaaccgggtccccggtaaccgggtccccgttccccgggcccccggtttaccgggtcccttcccgttttccccgg

SEQ ID NO: 439674 - DNA, 679 bp, Homo sapiens
  misc_feature: GZ8MTXP01C89TC.4.27.C05.1.454.CMB.2.raw
  modified_base (267)..(267): a, c, t, g, unknown or other
  modified_base (295)..(295): a, c, t, g, unknown or other
  modified_base (339)..(339): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacacgccaccattacctgccttactaggaaatgaattggactaagtattaagtttgtgtgttggtancgaagtgaggccaggccacgttcccttntttagctatgtatcggaataggaagcgccctgagggactcccgngacgcccgcttctctggactacccgaaacttcgtagggaaaccacgacgcccacgtctacgaccatacgacggaccgggtaacccttaaacgttttagaacgttggaacggtacccgttaacttacgtttaccgtcgttaccgtaacgtaccgggtagggtaccgtaagtcgggaccgtacgttacggcgttaacgtccggtttccggggacggggtaaacgggaacccgaaggtcccgttacggtaaccccggtccggttacggggttcgaccggaaccccggtaaacgggtcccgttacccggtccccccgttcgggttccccaacccgttttccccg

SEQ ID NO: 439675 - DNA, 602 bp, Homo sapiens
  misc_feature: GZ8MTXP01CDSHZ.4.27.C05.1.454.CMB.2.raw
  modified_base (256)..(256): a, c, t, g, unknown or other
  modified_base (286)..(286): a, c, t, g, unknown or other
  modified_base (593)..(593): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattacctgctctaggaaatgaattggacagtattaagttgtgtgttggtancgaagtgacggccaggccctagtccccttntttagctatgtatcgggaataacggaagccggccctagacgggtactcccgtgacgtcccgtcttcgtcgtggaacctacctaaaccgtcgtacgggaaaccaacgcgaccctaactcctacgaccacgtcgacggaccgggtaacccctaagtttacggagtacgacggaccgtaacttactttcgtacgtaccgaacgtacggtacggaacgtaggtggacctacgtcgcgtacgtcgtcggcggaacggacaggcttcgacccgtcgttcggccacgtcccgagccgtccgccccgttcgtccnccgttcccg

SEQ ID NO: 439676 - DNA, 672 bp, Homo sapiens
  misc_feature: GZ8MTXP01BDNWR.4.27.C05.1.454.CMB.2.raw
  modified_base (220)..(220): a, c, t, g, unknown or other
  modified_base (262)..(262): a, c, t, g, unknown or other
  modified_base (288)..(288): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactcgtccgtcgtccccaggacagacacgccaacctattaccngctctaggaaatgtaattggacagtattagttgtgtgtgtancgagtgagcaggcctacgttcccttntttagctagtgtagtacgggaatacggaacgccgccctacggagggtactcccgtaggacgtccccgtctttcgtcgtggtacctaaccgaacgttcggacgggaaacccacggtacaccctacgtcgtacgaccacgtccgaaccgggtaccgggtaaacccttaagtttaacgacgttacggaaccgggtaccttactttacgtttacgtacgttaccgaacggtacgggtacggtacaggtcgggacctagtcggtacgtacgttcggtcggggacggaacggaccgaacggtcgttaccgggtaccgttccggttcgggccttaccggcccgtacggtcccgtaccccggtccccgttcggtaaccttcccgtttccccg

SEQ ID NO: 439677 - DNA, 680 bp, Homo sapiens
  misc_feature: GZ8MTXP01B8N0Y.4.27.C05.1.454.CMB.2.raw
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtgtccccaggacagacacgccacctattacctgctcgtaggaaatgaagttggacagtattagtttgtgttgttgtatgaagtgacggccaggcctacgttcccctgtttagctagtgtagtcgggaatacggaaacgccggaccctgacgggtactcccgtaggcgtcccgtcttctcgtcggtactaacccgaaacttcgtacgggaaacctacgacgccctacgtcgtacgtaacccattaccggaacgggtaccgggtaacccttaaacgttttaggacgtacggaccggtaccgtaactttacgttcgtacggtaccgtaacggtaccgggtgggaacctaggtccggggacctacggtcggaccgttacgttccggttacggggacgggaacggtaccgaggtccgttcggtaccgttcgttaccgggttcacccggtaacccgacgggtcccttccccggccccgttacgtcccttcgtttccccg

SEQ ID NO: 439678 - DNA, 645 bp, Homo sapiens
  misc_feature: GZ8MTXP01CCZR7.4.27.C05.1.454.CMB.2.raw
  modified_base (224)..(224): a, c, t, g, unknown or other
  modified_base (259)..(260): a, c, t, g, unknown or other
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagacacgccacctattacctgctntaggaaatgaattgacagtatagttgtgtgtgtannagtgagcaggcctacgtcccttntttagcatgtacgtacgggataggaacgccggtcctcgacgggctcccgtgacgtcccgtccttcgtcgtacggacttaacccaacgttcggtaacgggaaaccaccgacgacccctactcgtacgaccctagtaccggaacggtacccgggtaacccttaaagttttacggagttcggaacggtcccgttaacttactttcgtcgtaccgtaacgtacggggttacgggacgtgtacgggcctacgttcgcgtacgttcgtcggggcgggaacgggtaccaggtccgttcggtacccgttcggacgggccacggtcccgacggtcccgtcccgtccccgttcggtcccttaacgttccccg

SEQ ID NO: 439679 - DNA, 798 bp, Homo sapiens
  misc_feature: GZ8MTXP01AWRYQ.4.27.C05.1.454.CMB.2.raw
  modified_base (216)..(216): a, c, t, g, unknown or other
  modified_base (287)..(287): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactcgtccgtgtccccaggacagacacgccaccattaccngctctaggaaatgaattggcagtattaagtttgtgtgttgtatcaagtgacgccaggcctacgtccccttntttagctagtgtagtcgggaataggaaacgccgcctgaggtactccgtgacgcccgtcttctcgtcgactaaccaacgtcggtaggaaaccacgacgcccacgtctacgacctagtaccgaacggacccgggtaaacccttaaacgttttaaggaacgttacgggtaaaccgggtcccgttaaactttacgttttaccgttaccggttaacccggtaaacgggtaaccggggttacgggaaacccgtagggttaacgggggccctaacggtttaccgggaccggttaacggtttccccgggttacccggggggaaccggggtaaacgggggaaacccccgttaaagggggtccccgtttaacccgggggtaaacccccgggtttcccggggtttaccgggggttacccgttaaaccccggggtaacccccgggaaaccggggttccccggttcccccgggtccccccccggtttaccggggttaaccccttccccgggttttccccccggg

SEQ ID NO: 439680 - DNA, 600 bp, Homo sapiens
  misc_feature: GZ8MTXP01CYD9Y.4.27.C05.1.454.CMB.2.raw
  modified_base (258)..(258): a, c, t, g, unknown or other
  modified_base (279)..(279): a, c, t, g, unknown or other
  modified_base (310)..(310): a, c, t, g, unknown or other
  modified_base (323)..(323): a, c, t, g, unknown or other
  modified_base (483)..(483): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtcccaggacagacacgccactattacctgctctagaaatgaattggacagtattagttgtgtgtgtancagtgagcaggcacgtccttntttagcatgagtcggatagaacgccggaccncgagggctcccgngacgtcccgtcttcgtcgtagactaacccaacgtcgtaacgggaaacacgtacgaccactcgacgaccagtacgaacggtaccgggtaacccttaagtttagacgtacggtacgtaccgttattacgtttcgtacgtacgtacgtacgggtcggtaacgngtacgggctacgtcgcgtacgttcggtacgggacggaacggtacgagtcgttacgaccgtcgcgggttccacggtaacccgacgtccgtccgtccccgttcggtccttccgttcccg

SEQ ID NO: 439681 - DNA, 602 bp, Homo sapiens
  misc_feature: GZ8MTXP01DSA5E.4.27.C05.1.454.CMB.2.raw
  modified_base (176)..(176): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccactattacctgctctagaaatgaattggacagtatagttgtgtgtgtatcaagtgaggcacggcctacgtccccttntttagctagtgtagcggatagaaacgcggtcctcgaggtactcccgtgacggtccctcttcgtctggactaccaactcgtagggaacactacgccgactctacgacactacgacgaccgtacctaacgtttacgatacggacgtacgtacttattacgtacgtaccgaacgtacgggtacggaacgtacgtacgggtcacgtacgcgtcgtcggttccgggcgggaacgggtaccgacggtcgttacggtcccggtcggttacgggcgaccggcccgtaacggtccgtacccggtccccgttcggtcccttccgtttcccg

SEQ ID NO: 439682 - DNA, 704 bp, Homo sapiens
  misc_feature: GZ8MTXP01A0U0M.4.27.C05.1.454.CMB.2.raw
  modified_base (262)..(263): a, c, t, g, unknown or other
  modified_base (286)..(286): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagacacgccacctattacctgctacgtaggaaatgaattggacagtattagttgtgtgtgannagtgagcaggcctacgtcccttntttagcagtgtagtcggatacggaacgccggacctgacgggtactcccgtagacgtccgtcttcgtcgtacggactaacccaacgtcgtacgggaaaccacgacgccctacgtcgtaccgacctacgtaccgacgggtaccggtaacccttaaacgttttacgacgttacggtaccggtacccgttactttaaccgtttcgtacggtaccgtaaacggtacgggttacggggaacgtacgggtcgggtacctacgtacggtaccggtacggttcccgggttaccgggggaaccgggaacgggtaacccgttacgggtaccgttccggtaccccgggtcggttaccggggttccgacccgggcccgacgggtccccgttcccggtcccccggttaccggtaacccttcccgtttccccg

SEQ ID NO: 439683 - DNA, 652 bp, Homo sapiens
  misc_feature: GZ8MTXP01AM8AI.4.27.C05.1.454.CMB.2.raw
  modified_base (256)..(256): a, c, t, g, unknown or other
  modified_base (279)..(279): a, c, t, g, unknown or other
  modified_base (291)..(291): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattacctgctactaggaaatgaattggcagtataagtttgtgtgtggtancaagtgagcaggccagtcccctntttagcatgtancgggaataggaagccggaccctgacgggtactcccgtgacgtccccgtctttctcgtgggaccttacccgaaaccttcggtaacggggaaaccacgacgtccctaactcgttaacgaccctagttaccgaacggtacccggggtaacccctaaacgtttttaacggacgttacgggaaccggtacccgtaacttaacgtttcgtacgtacgaacgtacgggtacgggaccgtagtcgggccacgtgcgtacgtcgtcgggcgggaacggaccgaggcgttccggtaccggtccgttggggttcccacggccccgtaaggtcccgtcccggcccccgttcggtaacccttccgtttccccgg

SEQ ID NO: 439684 - DNA, 714 bp, Homo sapiens
  misc_feature: GZ8MTXP01D6YCK.4.27.C05.1.454.CMB.2.raw
  modified_base (258)..(259): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcgggaggtgcctcagccatggcatggatccctctcttcctcggcgtccttgcttactgcacaggatgcgtgacctcttatgagctgactcagcccaccctcactcgtccgtcgtccccaggacagacacgccactattacctgctactagaaatgaattgacagtatagttgtgtgtgtannagtgagcagcctagttcccctntttagctatgtagtacggaatacggaacgccgccgtcgagggtactcccgtgacgtccgtcctttcgtcgtacggactaacccgaaacgttcgggtaacgggaaaccaccgaacgtccctaaccgttacgtaccgtaaccctacgtaccgtaacgggtacccggggtaaaccccttaaacgtttttaaacggacgttacgggaaccggtacccgttaacgttacgtttacgtaccgttaccggaacggtacgggtacgggtaaccgtaggtacgggaccgtaacgtcggtaccgtacggttcccggttaccggggaccggggtaaacgggaccgaacggtacccgttacggtaacccgggtccgttacgggttccgaccggaacccgacggtccctcccggcccccgttcggtaacccgttcccgtttccccg

SEQ ID NO: 439685 - DNA, 704 bp, Homo sapiens
  misc_feature: GZ8MTXP01CLNY5.4.27.C05.1.454.CMB.2.raw
  modified_base (257)..(257): a, c, t, g, unknown or other
  modified_base (288)..(288): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgttccttgcttactgcacaggatgcgtgacctcttatgagctgactcacgccaccctcactgtccgtcgtccccaggacagacacgccactattacctgctctaggaaatgaattgcagtattagttgtgtgtgtanacgagtgacgcacggtcctacgttccctttntttagctagtgtacggtacggaataacggaacggtccgacctaggacggtacctaccgtgacgtcccgttcttcgtacgtacgtacctaacccgtaacgttcggaacgggtaaaccacgaccgtccctacgttacgacccgaacctacgtacccggtaacgggtaaccccgggttaaaccctttaaaggtttacgacggtacggaccggtaaccttatttacgttcgtactaccgggaacggttacggggtaccgaactacggtcggccttaacggtcggtaccgtacgtttccgggacggggaccgggaacggtaacccttagggtccgttccggttacccgtcgggttcggcccgacccggtaaccgccggttcccgtacccccgtcccgttacgtaacccttccgtttccccg

SEQ ID NO: 439686 - DNA, 683 bp, Homo sapiens
  misc_feature: GZ8MTXP01EOPJU.4.27.C05.1.454.CMB.2.raw
  modified_base (299)..(299): a, c, t, g, unknown or other
  modified_base (352)..(352): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacacgccacctattacctgctacgtaggaaatgaattggactagtattagtttgtgttgttaggtatacgaagtgacggccacggcctacgttccccttntttacgctagtgtagtacggaataggaacgccggtcctcggacggtactccgnggacgtccgtcttcgtcgtaggtacctaacccgaacgtcgtacgggaaaccacgacgaccctactcgtacgaccctacgtacgacggtaccggtaacccttaacgttttagacgtcggtacggtaccgttacttacgtttacgtacgtacggaacgtacgggtacgggactaggtcgggacctagtacggtccgtacgttccggttccggggacgggaacgggaccgttaacggtccgttaaccggtcccggtccggttacgggccgaacccggcccgtaacggtccccgttcccggtcccccgttcggtaacccttaacccgtttccccg

SEQ ID NO: 439687 - DNA, 603 bp, Homo sapiens
  misc_feature: GZ8MTXP01BP32L.4.27.C05.1.454.CMB.2.raw
  modified_base (152)..(152): a, c, t, g, unknown or other
  modified_base (221)..(221): a, c, t, g, unknown or other
  modified_base (242)..(242): a, c, t, g, unknown or other
  modified_base (260)..(261): a, c, t, g, unknown or other
  modified_base (269)..(269): a, c, t, g, unknown or other
  modified_base (281)..(281): a, c, t, g, unknown or other
  modified_base (596)..(596): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcacgcccaccctcactcgtccgtcgtccccaggacagacacgccaacctattaccngctagtagaaatgaattgganagtatagttgtgtgtgannagtgagcngccacgtccttntttagctatgtagtcggaatagaacgcgcctagaggactccgtgacgtccgtcttcgtcgtacgactaacccaacgtcgtaacgggaaaccacgtaccgcctacgtactacgaacctacgtaccgaacgggtaccgggtaaaccccttaaagttttaacgacgttacggtaaccggtaccgtaactttacgttacgtacggtacgtaaacggtacgggttacggacgtaggtcgggcctacggtcgcgtagtcggtcgggacggaacggacaggcttcggaccgtcgcggcacgccgagcctccgccgttcgtcncgtcccg

SEQ ID NO: 439688 - DNA, 670 bp, Homo sapiens
  misc_feature: GZ8MTXP01BS079.4.27.C05.1.454.CMB.2.raw
  modified_base (248)..(248): a, c, t, g, unknown or other
  modified_base (255)..(256): a, c, t, g, unknown or other
  modified_base (269)..(269): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtgtccccaggacagacacgccactattacctgctacgtaggaaatgaattggcagtatagttgngtgtgannagtgagcaggccncgttccctntttagcatgtacgtcggataaggaagccggtcctgacggactcccgtggacgtccgtcctttcgtcgtaggacttaacccgaactccggtagggaaaccctacgaccgtacctactcgtacgaccacgtaccgaacgggaccgggttaaacccttaaagtttttaacggagttacggtaaccgggtaccgttaacgttaacgtttcgtacggtaccgtacggtaacgggttcgggacgttaacggtcggggacctacgtaccgggtactaccggttccggttccgggggacgggaacgggtaaccgacggttcgttaccggtacccggtcggttcgggttccacgggaaccccaggtcccgtacccgccccgttggtcccttcgtttccccg

SEQ ID NO: 439689 - DNA, 584 bp, Homo sapiens
  misc_feature: GZ8MTXP01AWATO.4.27.C05.1.454.CMB.2.raw
  modified_base (253)..(254): a, c, t, g, unknown or other
  modified_base (262)..(262): a, c, t, g, unknown or other
  modified_base (276)..(276): a, c, t, g, unknown or other
  modified_base (316)..(316): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtatagttgtgtgtgtannagtgagcnggccacgtcccttntttagcatgtatcggatagaacgcggcctgaggactccgngacgtccgtcttctcgtagactacccaacgtcgtacgggaacacacgccactctacgaccatacgacggaccggtaaccttaagtttacgacgttacggacgtccgtactttacttcgtacgtcgaacgtacggttacgggactacggtcggctacgtcgcgtacgtccggttacgggcgggaacggaccgagtcgttcggacccgtcggttacgggttccaccggcccgacggtccgtcccggccccgttggtcccttcgttccccg

SEQ ID NO: 439690 - DNA, 660 bp, Homo sapiens
  misc_feature: GZ8MTXP01AIKCO.4.27.C05.1.454.CMB.2.raw
  modified_base (177)..(177): a, c, t, g, unknown or other
  modified_base (255)..(255): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccttcttatgagctgactcagccaccctnactgtccgtgtccccaggacagacacgccacattacctgctctaggaaatgaattggcagtatagttgtgtgtggtancaagtgagccaggccagtccctntttagcatgtagtcggaatagaacgcgtccctagaggtactcccgtgacgtccccgtcttacgtcgtagggactaccccgtaaacgttcgaacggggaaacccacgaaccgtccctaacgtccgtacgaaccccagtaccggaaccggaaccgggtaaccccttaaaagttttacggaacgttacggaaccgggtacctaacttacgtttacgttcggtaccgaaacgtacgggtacgggaactaacggttgggacctacgttcgaccgtgtacggttcccgggaggaacggggaacttacggccgttcgtaccggttacgcgggttacgaaccggtcccgaggtcccgtccggtccccgttcgggccttaacgttccccgg

SEQ ID NO: 439691 - DNA, 709 bp, Homo sapiens
  misc_feature: GZ8MTXP01DNYWQ.4.27.C05.1.454.CMB.2.raw
  modified_base (215)..(215): a, c, t, g, unknown or other
  modified_base (260)..(260): a, c, t, g, unknown or other
  modified_base (285)..(285): a, c, t, g, unknown or other
tcagagcactgtagcacgaccggtgctcgatttagacgcgatcgaagggtttggggctgggcctacaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggacagtattaagtttgtgtgttggtancaagtgagccaggccagtccccttntttagcatgtagtcgggataggaaacgcgccctgagggactcccgtgacgcccgtcttctcgtggacttaacccaactcgtacgggaaacacgacgccctactctacgaccactacgacggaccgggtaaccctaaacgtttttaagaacgttacggaacgggtacccgtaacgtttactttaccgttacgttacccgtaaccggtaacggggtttacggggaacgtacggttacggggccgtaaaccgtcgggtaccgtaacggttcccggtttaccgggggaccggggtaaccggggtaacccgaaacgggtacccgttacggtaaccccgggttcccggttacggggttcccgaaccggaaccccgaaacgggtcccgtcccggtccccccggttcgggtccccttaacccgtttccccgg

SEQ ID NO: 439692 - DNA, 585 bp, Homo sapiens
  misc_feature: GZ8MTXP01AUJ51.4.27.C05.1.454.CMB.2.raw
  modified_base (262)..(262): a, c, t, g, unknown or other
  modified_base (286)..(286): a, c, t, g, unknown or other
  modified_base (326)..(326): a, c, t, g, unknown or other
  modified_base (539)..(539): a, c, t, g, unknown or other
  modified_base (569)..(569): a, c, t, g, unknown or other
  modified_base (577)..(577): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccacctattacctgcctactaggaaatgaattggacagtattaagtttgtgtgttgtancaagtgagcaggccacgtcccttntttagcatgatggatagaagcggccctgaggtactcccgngacgcccgtacttctcgtacggactaacccgaacgtcgtacgggaaacctacacgacctactctacgacccagtccgacggacccgggtaaccctaagtttacgataggtacggccgtacttacgtttctagtaccgtacgacggtgggacgtaggtcgggcacgtacgcgtacgttcgtcgggacgggaacggacgagcgttcgaccgtcgngggttccacgtcccgagcccgccgtccccncgtaaccncgttcccg

SEQ ID NO: 439693 - DNA, 663 bp, Homo sapiens
  misc_feature: GZ8MTXP01APU20.4.27.C05.1.454.CMB.2.raw
  modified_base (214)..(214): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagttgtgtgttggtatcaagtgaggccaggccacgtcccctctttagcatgtatcgggataggaaagcggccctcgagggtactcccgtgacgccgtcttcgtcgtggactaacccaacgtcgtacggggaaaccacgacgccctactctacgaccagtaccgacggccgggtaaccctaaacgttttaggacgttacggacggcccgtacttaacgtttctacggtacctaacgtacgggtagggaacgtacgtcggggcctaacgttcgggccggtaacgttccggttccgggggcgggaaccgggggaacccgttaaacgggtcccgttcggtaaccccgggttccgttacgggggttcccacgggtccccgaagggtcccgtcccggtcccccgttccgggtcccttaaccgtttccccg

SEQ ID NO: 439694 - DNA, 651 bp, Homo sapiens
  misc_feature: GZ8MTXP01DJ2IC.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccacattacctgctctaggaaatgaattggacagtataagtttgtgtgttggtatcaagtgaggccaggccagtccccttntttagtcatgtagtcgggaataggaaagccgggccctcgagggactcccgtggacgcccgtcctttctcgtggactaccccaaacttccgtaggggaaaccacgacggacccctactctacgaccctataccgacggaccggggaaccccttaaacgttttaaggacgttacgacgggtaccgtacttaacgtttactacgttcgtaacgtacgggtacgggacgagttcgggcacgtcgcgtagtccgttcgggcgggaacgggaaccgaaggccgttcggtacccggtccgttacgggttccgaccggccccgaaacggcccgttacccggcccccgttccgggttcccttaacccgtttccccg

SEQ ID NO: 439695 - DNA, 748 bp, Homo sapiens
  misc_feature: GZ8MTXP01CAI48.4.27.C05.1.454.CMB.2.raw
  modified_base (264)..(264): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagacacgccactattacctgcttcgtagaaatgaattggctagtatagtttgtgttgttggtancgaagtgaggccaggcctacgttccccttgtttagctagttgtagtcgggtaataaggaaacgcccggtcctacgagggtactccccgtaggacgtcccgtcctttacgttcgtacgggtaccttaaccccgtaacgtccggttaacggggaaacccacgaaccggtccctacgtactaccgactacgttcgaacgggtacccgggtaacccttaacgttttaacggacgtacggtacgggtacccgttacgttaactttccgtacggttacgtaaccgtacggggttccggaacgtacggttccggggacctaccggtcggtccgggtaaccttcgggttccggggaacggggtaaccgggaaccgaaacgggtccggttaccggtaacccggtcccggttaggggttcccgaccggtaaccccgtaacgggtcccgttaccccggtccccgttaccggtcccgttaacccggtttcccccgg

SEQ ID NO: 439696 - DNA, 592 bp, Homo sapiens
  misc_feature: GZ8MTXP01CA5AQ.4.27.C05.1.454.CMB.2.raw
  modified_base (152)..(152): a, c, t, g, unknown or other
  modified_base (156)..(156): a, c, t, g, unknown or other
  modified_base (220)..(220): a, c, t, g, unknown or other
  modified_base (239)..(239): a, c, t, g, unknown or other
  modified_base (257)..(258): a, c, t, g, unknown or other
  modified_base (261)..(261): a, c, t, g, unknown or other
  modified_base (263)..(263): a, c, t, g, unknown or other
  modified_base (266)..(266): a, c, t, g, unknown or other
  modified_base (269)..(269): a, c, t, g, unknown or other
  modified_base (274)..(274): a, c, t, g, unknown or other
  modified_base (277)..(279): a, c, t, g, unknown or other
  modified_base (282)..(282): a, c, t, g, unknown or other
  modified_base (297)..(297): a, c, t, g, unknown or other
  modified_base (306)..(306): a, c, t, g, unknown or other
  modified_base (345)..(345): a, c, t, g, unknown or other
  modified_base (350)..(350): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttangagctgactcacgcccaccctcactcgtcccgtcgtccccaggacagacacgccaccattaccngctgtagaaatgaattggnagtatagttgtgtgtgannagngngcngcntcctnttnnntgngtggatagacgcgcngaggctccngacgcgtcttcgtgtcgactaccactcgtacgggaaccncgacnccactcgacgacctataccggaacggtacccggtaaccttaacgtttaggacgttacggacgggtcctaacttcgttcgtcgtaccgacgtacggtcgggtaactacggtcggcctacgtcggccgtagtccggtcggggaacgggtaacgggaccaggtccgttacggtaccggtcgttacggggccacccggcccgacggtccgtccccggtccccggttacgtccgttcccgtttcccg

SEQ ID NO: 439697 - DNA, 267 bp, Homo sapiens
  misc_feature: GZ8MTXP01EZDHH.4.27.C05.1.454.CMB.2.raw
  modified_base (234)..(234): a, c, t, g, unknown or other
  modified_base (254)..(254): a, c, t, g, unknown or other
  modified_base (257)..(257): a, c, t, g, unknown or other
  modified_base (266)..(266): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctgaaatgaattgacgnagtatagttgtgtgtgtatnagngagcgcgcnc

SEQ ID NO: 439698 - DNA, 598 bp, Homo sapiens
  misc_feature: GZ8MTXP01BNGSQ.4.27.C05.1.454.CMB.2.raw
  modified_base (214)..(214): a, c, t, g, unknown or other
  modified_base (274)..(274): a, c, t, g, unknown or other
  modified_base (307)..(307): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctgaaatgaattggcagatagttgtgtgtgtatcaagtgagccaggccagtcccctntttagcatgatggatagaagcgctgaggctccngcgccgcttctcgtgactccaaactcgtagggaaaccagacgcccactcgtagacccatcgaaggccgggtaaaccctaacgtttagacgttaggacggtaccgacttaatttccgtacgtaccgacgtacggttacgggacgtacgtcggggacctactacggcgtaacgttccgttcggggccggaacggggaaccttaaacggccgttaggaccccgggtcgttaacggggccaacggccccgaacggggccttacccggcccccgttcggtaaccgaacccttcccg

SEQ ID NO: 439699 - DNA, 710 bp, Homo sapiens
  misc_feature: GZ8MTXP01BZ8EQ.4.27.C05.1.454.CMB.2.raw
  modified_base (220)..(220): a, c, t, g, unknown or other
  modified_base (269)..(269): a, c, t, g, unknown or other
  modified_base (362)..(362): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtcccgtcgtccccaggacagacagcccaccattaccngctacgtaggaaatgtaattggacaagtattaaggtttgtgtgttgtancgaagtgacggccaggcctacgtccccttagtttagctagtgtacgtcgggaataacggaacgtccgggaccctacggagggtaccttcccgngtacgtcccgtcttctcgtaggacctaacccaaacgttcgagggaaacccacgtaccgcctacgtactacgacctagtaccgacgggaccggtaaccttaacgtttagacgtacgtacggtaccgttaacgttaactttcgtacgttaccgtaacggtacgggttacgggaacgtacggttcggggaccttaacgtcggtacggtaccggttcggttaccggggacgggaaccgggtaaccgttaaacgggtccgttaccggtacccgtccggttcggggttacccgaccggaaccccggacggtcccgtcccggtccccgttccgggtccccgttaacgtttccccg

SEQ ID NO: 439700 - DNA, 584 bp, Homo sapiens
  misc_feature: GZ8MTXP01EZ4D7.4.27.C05.1.454.CMB.2.raw
  modified_base (216)..(216): a, c, t, g, unknown or other
  modified_base (256)..(256): a, c, t, g, unknown or other
  modified_base (280)..(280): a, c, t, g, unknown or other
tcagagcactgtagcacgaccggtgctcgatttagacgcgatcgaagggtttgggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattaccngctctggaaatgaattggcagataagttgtgtgttggtancaagtgaggcaggccagtcccctntttagcatgtatcggaatagaaaacggccctagagggatccctgacgcgtccttctctggactcccaaaactcgtcgggaaacacacgccactctacgacccagtcaaggcgggaaccctaaacgttttagaagtcggaacggcccgtaacttactttacgtaggttaccaacggtacggttaggggacctaagtcgggcacgtgcgatccgttcggcgggaggaaccaagcgtcgttacccgtcgtgggttccgacgcccgaaggcctccgcccccgttcggcctaaccgttccgttaacccg

SEQ ID NO: 439701 - DNA, 541 bp, Homo sapiens
  misc_feature: GZ8MTXP01B2ZHP.4.27.C05.1.454.CMB.2.raw
  modified_base (216)..(216): a, c, t, g, unknown or other
  modified_base (247)..(247): a, c, t, g, unknown or other
  modified_base (252)..(253): a, c, t, g, unknown or other
  modified_base (272)..(272): a, c, t, g, unknown or other
  modified_base (308)..(308): a, c, t, g, unknown or other
  modified_base (319)..(319): a, c, t, g, unknown or other
  modified_base (339)..(339): a, c, t, g, unknown or other
  modified_base (350)..(350): a, c, t, g, unknown or other
  modified_base (359)..(359): a, c, t, g, unknown or other
  modified_base (399)..(399): a, c, t, g, unknown or other
  modified_base (433)..(433): a, c, t, g, unknown or other
  modified_base (449)..(449): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtcccccaggacagacagccaccattaccngctctgaaatgaattggcagatagttgtgtntggannagtgagcagccagtccctntttagcatgatcggatagagcgcctgaggctcctgncgcttgctagntacccaatcgtggaaaccanacgccaactcncgaccctanacacggtacggacctactttacgatacggagacactattntacgcaacgagtaggacctaagtcggactacgtncgtacctgttaccggngggaacgggaaccaagcgttacgtaccccggtgcgggttcgaaccggcccgtaaggtcccgccccgtcccgttaccgtccgttaaccgtccg

SEQ ID NO: 439702 - DNA, 589 bp, Homo sapiens
  misc_feature: GZ8MTXP02JT63B.4.27.C05.1.454.CMB.2.raw
  modified_base (277)..(277): a, c, t, g, unknown or other
  modified_base (356)..(356): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttgatcaagtgaggccaggccagtcccctntttagcatgtatcggatagaagcggcctgagggactccctgacgcccgtcttctctggactccaactcgtagggaaacncgacgccactctcgaccatcacgccgggaaccctaacgttttagacgtggacggtcccgtacttactttctagtccacgaccggttagggacctagtcgggaccacgtcggcgtagttccgttcggggacgggtacggggacccaaggtccgtacggacccggttccgtcggggtaccacggaaccccgaacgggtcccgtccggtcccccgtcgggtccctaccgtttcccg

SEQ ID NO: 439703 - DNA, 508 bp, Homo sapiens
  misc_feature: GZ8MTXP02JG4S1.4.27.C05.1.454.CMB.2.raw
  modified_base (278)..(278): a, c, t, g, unknown or other
  modified_base (503)..(503): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggatcaagtgaggccaggccagtcccctntttagcatgtatcgggatagaaagcggccctgagggatccctgagcccgcttctctggactccgaactctgggaacacagccactctgaccatccagccgggaccctaacgtttagatgaggccgtactattctgtcacacgtgggacagtggcactgcgatcgtcggcggacgggaccaaggctcgaccgtcgcgggtcacgccgaaggctcgcccctcggccnctccg

SEQ ID NO: 439704 - DNA, 539 bp, Homo sapiens
  misc_feature: GZ8MTXP02IUCYW.4.27.C05.1.454.CMB.2.raw
  modified_base (279)..(279): a, c, t, g, unknown or other
  modified_base (307)..(307): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgtggtatcaagtgaggccaggccagtcccctntttagcatgtatcggatagaagcgcctnagggactccgtgacgccgtcttctctggactccaactcgtgggaaaccacgagcccaactctcgaccatcacgccgggaaccctaatttagatgacggcctatactttctgttacacgtggtggacagtgggcacgtgcgattcgtcgggcggaacgggaccaagcgtacggaccgttccgtcgggtcacgaacccgaacggccttccgcccccgtacggtcctcgttcccg

SEQ ID NO: 439705 - DNA, 520 bp, Homo sapiens
  misc_feature: GZ8MTXP02I3989.4.27.C05.1.454.CMB.2.raw
  modified_base (280)..(280): a, c, t, g, unknown or other
  modified_base (311)..(311): a, c, t, g, unknown or other
  modified_base (413)..(413): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggccctnagggatccctgagccgcttctctggactcccaactcgtgggaaacacgagcccactctgaccatcagcgggaccctaactttagatgaggccgactatttcngtcacacgtgggacagtgggcactgcgatcgttcgggcggacgggaccaaggctacgaccgtcgtcgggtcacgcccgaaggcctcgcccccgtcggtccacttccg

SEQ ID NO: 439706 - DNA, 507 bp, Homo sapiens
  misc_feature: GZ8MTXP02JQLAG.4.27.C05.1.454.CMB.2.raw
  modified_base (278)..(278): a, c, t, g, unknown or other
  modified_base (308)..(308): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcggatagaagcggccctnagggatccctgacgccgcttctctggactccgaactcgtagggaacacgacgccactctcgaccatcagccggaccctaactttagatgacgccgactattctgtcacacgtggacagtggcacgtgcgatcgtcggcggacggacaggctgaccgtcgtcgggtcacgccgaaggcctcgcccctcggtccacgtccg

SEQ ID NO: 439707 - DNA, 504 bp, Homo sapiens
  misc_feature: GZ8MTXP02G2BB2.4.27.C05.1.454.CMB.2.raw
  modified_base (279)..(279): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaagcggcctcagggatcccgtgagccgcttctctggactccaactctgggaacacagccactctgaccatcagcggacccaactttagatgagccgatatttctgtcacacgtgggacagtgggcacgtgcgatcgttcggcggagggaccaagctgaccgtcgtacgggtcagcccaaggcctcgccccctcggtccacgttccg

SEQ ID NO: 439708 - DNA, 520 bp, Homo sapiens
  misc_feature: GZ8MTXP02IWRG8.4.27.C05.1.454.CMB.2.raw
  modified_base (279)..(279): a, c, t, g, unknown or other
  modified_base (307)..(307): a, c, t, g, unknown or other
  modified_base (318)..(318): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcggatagaagcgcctnagggatcccgngacgccgcttctctggatcccaactcgtagggaacacagccactctcgaccatcagccggacctaacgtttagactgacgccgatatttctgtcacgtacgtgggacagtgggcacgtgcgtatcgtcggcggacgggaccaaggctcggacgtccgtgggtccacgcccgaaggcctccggccccctcggtcctacttccg

SEQ ID NO: 439709 - DNA, 585 bp, Homo sapiens
  misc_feature: GZ8MTXP02INMTZ.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggcaggccagtcccctntttagcatgtatcggatagaagcgcctgaggatcctgacgccgcttctctggactccaactcgtagggaacacgacgcccactctacgaccagtaccgacgaccgggaacccttaaacgtttttacgacgttacggacggtacccgtacttagttttaccgtcgttaccgaacgtacggtcgggtacaacgtcggggctacgtcgacgtagttccgtcggggcggtaacgggaccgaaagccgtacggacccgtcgtacggggtcacggaacccgacggcctaccggcccctcggtccacgttcccg

SEQ ID NO: 439710 - DNA, 529 bp, Homo sapiens
  misc_feature: GZ8MTXP02JM804.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccatgccagtcccctntttagtcatgtatcgggatagaaagcggcctgagggactcccgtgaccgcgtcttctctggactcccactcgtagggaaaccacagcccactctgaccatcgacggccgggaaccctaactttagatcggacgaccgacttatttctgttcacgtacggtgggactagtgggcacgtgcgtagtcgtcggcggacggaccagctacgaccgtcgtggcaacgcccgaaggcctcgcccctcggtactccg

SEQ ID NO: 439711 - DNA, 531 bp, Homo sapiens
  misc_feature: GZ8MTXP02HOXZA.4.27.C05.1.454.CMB.2.raw
  modified_base (253)..(253): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgtgtatnaagtgaggccaggccagtcccctntttagcatgtatcggatagaaagcggcctgaggactcccgtgagccgcttctctggactccaactcgtgggaacacacgccactctgaccatcagaccggacctaacgtttagatgacgccgactattctgtcacgtacgtgggacagtcgggcacgtgcgtagtcgttcgggcgggacgggaccgaagcgtcgaccgtccgacgggtccacgaacccgaacggcctccggcccccgtcggtcctacgttcccg

SEQ ID NO: 439712 - DNA, 531 bp, Homo sapiens
  misc_feature: GZ8MTXP02HSLWC.4.27.C05.1.454.CMB.2.raw
  modified_base (276)..(276): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgtggtatcaagtgagcaggccagtcccctntttagcatgtatcggataggaaagcggccctgagggactccctgagcccgtcttctcgtggactcccaaacttcgtagggaaacaccacgcccactctcgaccatcacgaccggaccctaacttttagatgacggccgtacttattctgtacacgtacgtaggacagtgggcacgtgcgatcgtcgggcggtacggaccgaagctcggaccgtcgtcggtcacgcccgaggcctacgccccgtcggtccactccg

SEQ ID NO: 439713 - DNA, 522 bp, Homo sapiens
  misc_feature: GZ8MTXP02F9ZXN.4.27.C05.1.454.CMB.2.raw
  modified_base (278)..(278): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagtttgtgtgttggtatcaagtgaggccaggccagtcccctntttagcatgtatcgggatagaaagcggccctgagggactccctgagccgcttctctggatcccaaactcgtagggaaacacacgcccaactctagaccatcagacggacccaactttagatgagccgactattctgtcacacgtgggacagtcgggcacgtgcgatcgtcggcggacgggaccgaagctacgaccgtccgtcgggtcacggcccgaacggctcgcccctcggtccacgttcccg

SEQ ID NO: 439714 - DNA, 619 bp, Homo sapiens
  misc_feature: GZ8MTXP02GYRUS.4.27.C05.1.454.CMB.2.raw
  modified_base (213)..(213): a, c, t, g, unknown or other
  modified_base (276)..(276): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctaggaaatgaattggcagataagttgtgtgtgtatcaagtgagccaggccagtcccctntttagcatgtatcggatagaagcggcctgagggactcccgtgagccgtcttctctaggactaccaactcgtagggaaacacacgcccatctagaccatccgagccgggaaccctaaacgttttagactggacggaccgtacttactttctcgttacaacgtacggtgggtacaggtcgggacacgttcggacgtacgttcgttacggggacgggaacgggacccgtaaaggtccgttacgggaacccggttcccgttcgggggtaccctaaccgggaaccccggaaacggggtccccgttacccggcccccccgtttacgggtccctaacccgtttcccccgg

SEQ ID NO: 439715 - DNA, 543 bp, Homo sapiens
  misc_feature: GZ8MTXP02F6V7A.4.27.C05.1.454.CMB.2.raw
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggacagtataagtttgtgtgttggtatcaagtgaggccaggccagtcccctnttttagcatgtatcggatagaaagcggccctgagggactccctgacgcccgcttctctggatcccaactcgtagggaaacacacgcccactctagaccatcagcgggaccctaactttagatgacgccgactattctgtcacgacgtgggacagtcgggcacgtgcgtatcgttcgggacggacgggaccgaggtacgtcgaccgtccgtcgggtcgacggcccgaacgccgtccggcccccgtcggtcctaccttcccg

SEQ ID NO: 439716 - DNA, 509 bp, Homo sapiens
  misc_feature: GZ8MTXP02HIDUP.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagtcatgtatcgggataggaaagcggccctcgagggatccctgagcccgcttctctggatccgaactctgggaacacagccactctgaccatcagcgggacccaactttagatgaggccgactagtttctgtcactacgtgggacagtgggcactgcgatcgtcggcggacggaccaagctgaccgtcgtgggtcagcccgaaggcctcgcccctcggtccactccg

SEQ ID NO: 439717 - DNA, 550 bp, Homo sapiens
  misc_feature: GZ8MTXP02FWCGE.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgagcaggccagtcccctntttagcatgtatcggatagaagcgcctgagggactccgtgacgccgtcttctctggactcccaactcgtagggaaacacgacgcccactctacgaccatccgacggaccgggaaccctaaacgttttacgacgttacggaacggtccgtaacttactttactcgtaccacgtacggtgggaccgtagtcgggcacgtgcgagtcgttcgggcggacggacagctcgaccgtcgtcggtcacgccgacggctccggcccctcggtccactccg

SEQ ID NO: 439718 - DNA, 545 bp, Homo sapiens
  misc_feature: GZ8MTXP02G7G07.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagtcatgtatcggatagaaagcggcctgaggatcccgtgagccgcttctctggactccaactcgtagggaacacgacgccactctcgaccatcagccgggaaccctaacgtttagacgtgacgggacctacttactttctgtacacgtacggtgggacagtcgggacacgtgcgatcgtcgggcggtacggaccaagccgtggaccgtccgtcgggtccacgaacccgaacggccgtccgcccccgtcggtcctacgttcccg

SEQ ID NO: 439719 - DNA, 616 bp, Homo sapiens
  misc_feature: GZ8MTXP02F4UAX.4.27.C05.1.454.CMB.2.raw
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagtttgtgtgttggtatcaagtgaggccaggccagtcccctntttagcatgtatcggatagaagcgcctgaggactccgtgacgcccgcttctctggactcccaaactcgtagggaaaccacgacgcccactctacgaccatcgacgaccgggaaccctaacgttttagattaggacggtaccgtacttatttacgtcgtactacgtacggtagggacctagtcggggcaccgttggacgtacgttccgttcggggacgggaacggggacccgaaacggtccgttacgggaacccgttccggtacggggtaccgaccggaaccccgaaacgggcccgttaccggccccccgttccgggtacccgtacctttccccg

SEQ ID NO: 439720 - DNA, 513 bp, Homo sapiens
  misc_feature: GZ8MTXP02IKGGD.4.27.C05.1.454.CMB.2.raw
  modified_base (280)..(280): a, c, t, g, unknown or other
  modified_base (355)..(355): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggcctcagggatcccgtgacgccgcttctctggatccaactctgggaaacncacgccactctgaccatcagcggaccaacttttagatgaggccgactatttactgtcactacgtgggacagtgggcacgtgcgatcgtcggcggacggacaagctggaccgtccgtcgggtcacgcccgaacggctacgccccgtcggtccacttccg

SEQ ID NO: 439721 - DNA, 559 bp, Homo sapiens
  misc_feature: GZ8MTXP02HUOJF.4.27.C05.1.454.CMB.2.raw
  modified_base (213)..(213): a, c, t, g, unknown or other
  modified_base (279)..(279): a, c, t, g, unknown or other
  modified_base (321)..(321): a, c, t, g, unknown or other
  modified_base (335)..(335): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctggaaatgaattggcagtataagttgtgtgttggtatcaagtgaggccaggccagtcccctntttagtcatgtatcggatagaaagcggccctgagggatcccngacgccgcttctcnggatcccaatcgtgggaaacacacgaccactctcgacccatcacgcgggaaccctaactttttagagttggacggaccgtacttaatttctgttccacgtaccggtagggacagtgggacacgtgcgagtccgttcggggcggacgggacctaacggctcggaccgtccgtcgggtccacgaacccgaacggccgtccggcccccgtccggtctaccgttcccg

SEQ ID NO: 439722 - DNA, 560 bp, Homo sapiens
  misc_feature: GZ8MTXP02INSOQ.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttgatcaagtgaggccaggccagtccccctnttttagctatgtatcggatagaaagcggccctgagggactccctgacgcccgtcttctcgtggactccaactcgtagggaaacacagcccactctacgaccatcacgaccgggaccctaaacgttttagacgttggaacggccgacttactttctgttacacgtacggtcgggacagtggcacgtgcgtatcgtcggcggacggaccgaagctacggaccgtccgtacggggtcacggcccgaacggtccgtccggcccccgtcggtcctaccgtttcccg

SEQ ID NO: 439723 - DNA, 642 bp, Homo sapiens
  misc_feature: GZ8MTXP02H601I.4.27.C05.1.454.CMB.2.raw
  modified_base (175)..(175): a, c, t, g, unknown or other
  modified_base (242)..(242): a, c, t, g, unknown or other
  modified_base (250)..(250): a, c, t, g, unknown or other
  modified_base (272)..(272): a, c, t, g, unknown or other
  modified_base (374)..(374): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccaccattacctgctctaggaatgaattggcagatagttgngtgtgatnaagtgagcaggccagtcccctntttagcatgatcggataggaagcgccctgaggactccgtgacgccgctttcgcgtggactccaacgtcgtacgggaaacacgacgaccactctacgacccancgaacgaccgggtaaccctaacgttttaagacgttacggaacggacccgtacttaactttcgtacggttaccaacgtacggtacggggtaaccaacgggttggggacctaacgttcggacggttaacgttcggtttaccgggggacggggtaacgggaaaccgtaaacggccgttacggacccggttccggtacggggttccgaaccggtaaccccgaaacggcccgtacccggtccccccggttccggtaccctaaccgtttccccg

SEQ ID NO: 439724 - DNA, 505 bp, Homo sapiens
  misc_feature: GZ8MTXP02GA01Z.4.27.C05.1.454.CMB.2.raw
  modified_base (280)..(280): a, c, t, g, unknown or other
  modified_base (313)..(313): a, c, t, g, unknown or other
  modified_base (334)..(334): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctnttttagcatgtatcgggatagaaagcggccctnagggatccctgagccgcttcnctggatccaatctgggaacacagccactctgaccatcagcggacccaactttacgatgagcgactattactgtcacacgtggacgatgggcactgcgatcgttcggcggacgggacaagcgtcgaccgtccgcgggtcacgcccgaaggctcgcccccgtcggtcactccg

SEQ ID NO: 439725 - DNA, 671 bp, Homo sapiens
  misc_feature: GZ8MTXP02IFO9Z.4.27.C05.1.454.CMB.2.raw
  modified_base (247)..(247): a, c, t, g, unknown or other
  modified_base (282)..(282): a, c, t, g, unknown or other
  modified_base (325)..(325): a, c, t, g, unknown or other
  modified_base (339)..(339): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagattaagtttgngtgttggatcaagtgaggccaggccagtccccttntttagcatgtatcgggatagaaagcggccctgagggactccgngacgcccgtcttcncgtggactaccaactcgtagggaaacacgacgccctactctcgaacctactacgacggccgggaacccttaaacgttttagacgttaggaacggtaccgtaacttaactttccgttacgtaccgtacgtaacgggtacgggtaacgaacggttcgggggaacctacgttacggacggttaacgttccgggtttacggggaccggggaacgggtaaaccgaaacggccgttaccgggtaacccggttccggtacggggtaccgaaccggaaccccggaaacgggtcccgtccccggtacccccgtttccgggtaccctacccgtttcccccgg

SEQ ID NO: 439726 - DNA, 532 bp, Homo sapiens
  misc_feature: GZ8MTXP02GTVDP.4.27.C05.1.454.CMB.2.raw
  modified_base (278)..(278): a, c, t, g, unknown or other
  modified_base (308)..(308): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgtggtatcaagtgaggccaggccagtcccctntttagcatgtatcggatagaagcggccctnagggatccctgagccgcttctctggactcccaactcgtaggggaaacaccagcccactctcgacccatccgagcggggaaccctaacttttagattgacggccgtacttatttctgttcacgacgtgggactagtcgggcacgtgcgatcgtcgggcggagggaccaagctagaccgtccgtcgggtcacggccgaggcctcggcccccgtcggtccacttccg

SEQ ID NO: 439727 - DNA, 514 bp, Homo sapiens
  misc_feature: GZ8MTXP02FXKHE.4.27.C05.1.454.CMB.2.raw
  modified_base (279)..(279): a, c, t, g, unknown or other
  modified_base (311)..(311): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcgggatagaaagcggccctnagggatccctgagccgcttctctggatcccaactctgggaaacacgagccactctgaccatcagacgggaccctaactttagatgacggccgacgtatttctgtcacacgtggacagtcggcactgcgagtcgttcggcggacgggaccgaagcgtagaccgtccgtaggtcagcccgaaggctcgccccgtcggtcacgtcc

SEQ ID NO: 439728 - DNA, 527 bp, Homo sapiens
  misc_feature: GZ8MTXP02F7ZZ9.4.27.C05.1.454.CMB.2.raw
  modified_base (279)..(279): a, c, t, g, unknown or other
  modified_base (331)..(331): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggcctgagggatccctgacgccgcttcnctggactcccgaaactcgtgggaaacacagcccactctgaccatcagcggacccaactttagatgacggcactattctgtcacacgtgggacatcgggcacgtgcgatcgtcgggcggacgggaccaaggctacggaccgtccgtcggggtcaacggcccgaaacgggcctcggcccccgtcggtccacgttcccg

SEQ ID NO: 439729 - DNA, 569 bp, Homo sapiens
  misc_feature: GZ8MTXP02GV884.4.27.C05.1.454.CMB.2.raw
  modified_base (214)..(214): a, c, t, g, unknown or other
  modified_base (244)..(244): a, c, t, g, unknown or other
  modified_base (278)..(278): a, c, t, g, unknown or other
  modified_base (306)..(306): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagttgngtgtggtatcaagtgaggccaggccagtcccctntttagcatgtatcggatagaagcgcctnagggatccgtgagccgcttctctggactccaactcgtagggaacacagcccactctacgaccataccagccggggaccctaaaccgttttagacgttaggacgggtcccgtaacttaactttctggtttaccacgtacgttaggggacaagtcggggacaccgtgccgtagtccgttacgggcggacgggacccaaaggctcggaccgtccgtcgggtccacggcccgaacggccgtccgcccccgtcggtcctacgttcccg

SEQ ID NO: 439730 - DNA, 516 bp, Homo sapiens
  misc_feature: GZ8MTXP02HNGU1.4.27.C05.1.454.CMB.2.raw
  modified_base (214)..(214): a, c, t, g, unknown or other
  modified_base (277)..(277): a, c, t, g, unknown or other
  modified_base (306)..(306): a, c, t, g, unknown or other
  modified_base (366)..(366): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagttgtgtgttgtatcaagtgagccaggccagtcccctntttagcatgtatcggatagaagcggcctnagggatccctgacgccgtcttctctggactccgaactcgtagggaacacacgcccactcngaccatcgagccggaccctaacgtttagatgacgcctactatttctgtcactacgtgggacagtcggcacgtgcgatcgtcgggcgacgggaccaagctcgaccgtcgtggtccagcccgaggcctcggccccctcggtcctaccttccg

SEQ ID NO: 439731 - DNA, 520 bp, Homo sapiens
  misc_feature: GZ8MTXP02IJ26P.4.27.C05.1.454.CMB.2.raw
  modified_base (252)..(252): a, c, t, g, unknown or other
  modified_base (274)..(274): a, c, t, g, unknown or other
  modified_base (404)..(404): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagttgtgtgtgtatnaagtgagcaggccagtcccctntttagcatgtatcggatagaagcgcctgaggatccgtgagccgtcttctctggactccaactcgtagggaacacgacgccactctcgaccatcagcggaccctaacgtttagatgacgacgtactattcngttacacgtagtggacagtggacacgtgcgatcgtcggcggacggaccgtaagctacggaccgtcgtcgggtacacggaacccgaggccgtaccgccccgtcggtcctacttcccg

SEQ ID NO: 439732 - DNA, 562 bp, Homo sapiens
  misc_feature: GZ8MTXP02GDI78.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgtggtatcaagtgaggcaggccagtcccctntttagcatgtatcggatagaagcggccctgaggatcccgtgacgccgctttctctggactcccaactcgtagggaaacacagcccactctacgaccatcgacgaccgggaaccctaacgttttagacgttaggacggtaccgacttactttctcgtactaacgacggttcgggactagtcgggcacgtcgcgagtcgttcgggacggacgggaccaaggtcgtacggaccgtccgtcgggtcgacgcccgaacggccgtccgccccgtcggtcctacgttcccg

SEQ ID NO: 439733 - DNA, 539 bp, Homo sapiens
  misc_feature: GZ8MTXP02IYHJM.4.27.C05.1.454.CMB.2.raw
  modified_base (214)..(214): a, c, t, g, unknown or other
  modified_base (280)..(280): a, c, t, g, unknown or other
  modified_base (309)..(309): a, c, t, g, unknown or other
  modified_base (415)..(415): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagttgtgtgttggtatcaagtgaggccaggccagtcccctntttagcatgtatcggatagaagcggcctnagggactccctgacgccgtcttctctggactccgaactcgtgggaaacacagccaacgtctcgaccatcagccggaacctaactttagatgacgccgtatatttcngtacacgtacgtggacagtcgggcacgtgcgatcgttcgggcggaacggaccaaaggcctacggaccgttccgtcgggtcacggcccgaacggcctaccggcccccgtcggtcctaccttcccg

SEQ ID NO: 439734 - DNA, 526 bp, Homo sapiens
  misc_feature: GZ8MTXP02H2VX8.4.27.C05.1.454.CMB.2.raw
  modified_base (213)..(213): a, c, t, g, unknown or other
  modified_base (242)..(242): a, c, t, g, unknown or other
  modified_base (250)..(250): a, c, t, g, unknown or other
  modified_base (271)..(271): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaatgaattggcagatagttgngtgtgatnagtgagcaggccagtcccctntttagtcatgtatcggatagaaagcgcctgaggactcctgagccgcttctctggactccaactcgtacgggaaacacagccactctagaccatcgacgccggaaccctaacgttttagagttgacggaccgtattacttctagttcacgtacgtgggacagtggacacgtgcgtagtcgtcggcggacggaccaaggctcggaccgtccgacgggtcacggcccgaacggcctccgccccgtcggcctacgtccg

SEQ ID NO: 439735 - DNA, 554 bp, Homo sapiens
  misc_feature: GZ8MTXP02JUDK5.4.27.C05.1.454.CMB.2.raw
  modified_base (213)..(213): a, c, t, g, unknown or other
  modified_base (278)..(278): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagttgtgtgttggtatcaagtgaggccaggccagtcccctntttagcatgtatcggatagaaagcggccctgagggactcccgtgacgccgtcttcgtctaggactcccaactcgtacgggaaacacgacgcccaactctacgacccacgtcacggccgggaaccctaacgtttagacgtcgacggccgtacttattctgtacacgacgtcggacagtggcactgcgtagtcgttcgggcggacggaccgagcgtacgaccgtccgtcgggtacacgcccgaacggccgtcggcccccgtcggtacctacgttcccg

SEQ ID NO: 439736 - DNA, 517 bp, Homo sapiens
  misc_feature: GZ8MTXP02H6S9C.4.27.C05.1.454.CMB.2.raw
  modified_base (213)..(213): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtcccaaggacagacagccaccattaccngctctggaaatgaattggcagataagttgtgtgttggtatcaagtgaggccaggccagtcccctntttagcatgtatcgggatagaagcggcctcagggatccctgagccgcttctctggatccaactcgtgggaacacgagccactctgaccatcagcgggaacccaacttttagatgaggccgactagtttactgtcacgacgtgggacagtgggcacgtgcgatcgtcggcggtacgggaccaaggctacgaccgtccgcgggtcaggcccgaaggcctcgccccctcggtaccactcccg

SEQ ID NO: 439737 - DNA, 532 bp, Homo sapiens
  misc_feature: GZ8MTXP02H74IA.4.27.C05.1.454.CMB.2.raw
  modified_base (280)..(280): a, c, t, g, unknown or other
  modified_base (311)..(311): a, c, t, g, unknown or other
  modified_base (379)..(379): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggccctnagggactccctgagccgctttctctggatcccaaactcgtagggaaacacagcccactctgaccctancagccgggaaccctaacttttagattgacggccgtactatttctgttacacgtacggtgggacagtcgggacactgcgatcgtcgggcggagggaccaagctagaccgtcgcgggtcacgcccgaaggcctcggccccctcggtccacgtccg

SEQ ID NO: 439738 - DNA, 623 bp, Homo sapiens
  misc_feature: GZ8MTXP02H8565.4.27.C05.1.454.CMB.2.raw
  modified_base (275)..(275): a, c, t, g, unknown or other
  modified_base (384)..(384): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagatagttgtgtgtgtatcaagtgagccaggccagtcccctntttagcatgtatcggatagaagcggccctgagggactcccgtgagccgtcttctctggactcccaaactccgtagggaaaccacgacgccctaactcgtcgaaccctanaccgacggacccggtaaacccttaaacgttttaacgacgtacggacggtacccgtacttactttacgtcgttaccaacggtacggtacgggacaggtcgggacctacgtcggacgtacgttccggtacggggaccgggaacgggaccgaaacggtcgtacggtacccggttccggtacgggtaccgaccggaacccgaacggtcccgtcccggtacccccgtcggtacctacccgtccg

SEQ ID NO: 439739 - DNA, 515 bp, Homo sapiens
  misc_feature: GZ8MTXP02IFYK6.4.27.C05.1.454.CMB.2.raw
  modified_base (244)..(244): a, c, t, g, unknown or other
  modified_base (274)..(274): a, c, t, g, unknown or other
  modified_base (330)..(330): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgngtgtgatcagtgagccaggccagtcccctntttagcatgtatcggatagaaagcggccctagagggactcccgtgacgccgcttcncgtggatcccaactcgtagggaacacacgcccactctcgaccatcagccggaccctaactttagatgacggccgacttatttcgtgtcacgtacgtggacagtggcacgtgcgatcgtcggacggacggaccagctcgaccgtccgcggtcacgccgaggcctccgccccgtcggtcctactccg

SEQ ID NO: 439740 - DNA, 630 bp, Homo sapiens
  misc_feature: GZ8MTXP02GUJG7.4.27.C05.1.454.CMB.2.raw
  modified_base (275)..(275): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctaggaaatgaattggcagataagttgtgtgtgtatcaagtgagcaggccagtcccctntttagcatgtatcggatagaaagcgcctgaggatcctgacgccgcttctctggactccaactcgtacgggaaacacgacgcctaactcgtacgaccaatcgaacgaccgggaaccctaaacgtttttaacgagttacggaacggtacccgtaaccgttaagtttccttacggttacctaaccgtacgggttacgggaaccgtaaggttcggggaccaacgttcggacgtacgttccgttacggggacgggaacgggaacccgaaagtccgtacggtacccgttcccggttcggggtaccaacggcccgaaacgggtccgtacccgtcccccgtaccgggtccgtacctttcccgg

SEQ ID NO: 439741 - DNA, 565 bp, Homo sapiens
  misc_feature: GZ8MTXP02JHSPU.4.27.C05.1.454.CMB.2.raw
  modified_base (214)..(214): a, c, t, g, unknown or other
  modified_base (281)..(281): a, c, t, g, unknown or other
  modified_base (286)..(286): a, c, t, g, unknown or other
  modified_base (554)..(554): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagttgtgtgttggtatcaagtgaggccaggccagtcccctntttancatgatcggatagaagcgcctgagggactccgtgacgccgcttctctggactaccaactcgtagggaaacacgacgcctactctgaccatacacgccgggaaccctaactttagatacgacggtccgtattactttctggtaccacgtacggtagggacagtcgggacacgtgcgattccgtacgggcggaacgggaccaaggccgtacgacccggtcgtacgggtaccacggaacccgaacggtccgtccggcccccgtcggtaccnccgtttccccg

SEQ ID NO: 439742 - DNA, 558 bp, Homo sapiens
  misc_feature: GZ8MTXP02JPDUT.4.27.C05.1.454.CMB.2.raw
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagatagttgtgtgtgtatcaagtgaggccaggccagtcccctntttagcatgtatcggataggaaagcggccctgagggatcccgtgacgcccgtcttctctggactccaactcgtagggaaacacgacgccactctcgaccatccgacgccgggaccctaaacgttttagacgtggacggccgtacttactttctcgttacacgtacggtgggacgagtcgggacacgtgcgattccgtcgggacggacggaccaagcgtcgaccggtccgtcgggtacacggcccgaaggtcccgccgtccccgtcggtcctaccgttcccg

SEQ ID NO: 439743 - DNA, 643 bp, Homo sapiens
  misc_feature: GZ8MTXP02IQ86C.4.27.C05.1.454.CMB.2.raw
  modified_base (276)..(276): a, c, t, g, unknown or other
  modified_base (305)..(305): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgagccaggcagtcccctntttagctatgtatcggatagaagcgcctnagggctcctgacgccgtcttctcgtggactaccaactcgtgggaacacacgcccacgtctacgacccatccacgccgggaaccctaaacgttttagacgttagacggtaccgtaacttactttctcgtaccacgtaccggtgggaccacggtcgggaccgtaacgttcggaccggtacgttaccggttccggggaaccgggtacggggaacccgtaaacgggtccggttaccggtaaccccggttccggtaccggggtaccgaaccggtaaccccgaaaaccggggtccgttaccccggtaccccccgttccggggttacccctaaccgtttcccccg

SEQ ID NO: 439744 - DNA, 599 bp, Homo sapiens
  misc_feature: GZ8MTXP02G1KX4.4.27.C05.1.454.CMB.2.raw
  modified_base (215)..(215): a, c, t, g, unknown or other
  modified_base (258)..(258): a, c, t, g, unknown or other
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattaccngctctaggaaatgaattggcagataagtttgtgtgttggtatnaagtgaggccaggccagtccccttntttagcatgtatcggatagaagcgcctgaggatccctgagcccgtcttctcgtaggactccaactcgtagggaaaccacgacgcccaactctacgaacccataccacggaccgggaaccctaacgttttaacgacgttcggaacgggtacccgtacgttaacgtttcgtacgttaccaacgtacggtaggggaactaaggttcgggactaccgtaggcgtacgttcggttcgggacggtacgggaccgtaaggcgtacggacccgtcgtacgggtcacggcccgaggccgtccgcccccgtcggtcctacttcccg

SEQ ID NO: 439745 - DNA, 534 bp, Homo sapiens
  misc_feature: GZ8MTXP02JXSSD.4.27.C05.1.454.CMB.2.raw
  modified_base (214)..(214): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagtttgtgtgttggtatcaagtgaggccaggccagtcccctnttttagcatgtatcggataggaaagcggccctcagggactccctgacgccgcttctctggactccaactcgtgggaaacacacgccactctgaccatcacgcgggaccctaacgtttagatgacggaccgtacttatttctgtcacgacgtaggacagtgggcacgtgcgatcgtcggcggacggaccaagcgtacgaccgtccgcgggtaccacggcccgaaggtcctcggcccccgtcggtccacgttcccg

SEQ ID NO: 439746 - DNA, 734 bp, Homo sapiens
  misc_feature: GZ8MTXP02JJL0K.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgtggtatcaagtgagccaggccagtcccctntttagcatgtatcggataggaacgcggcctgagggactcccgtgacgcccgtcttcgtctcggtactacccaaacgttcgtacggggaaaccacgaacgccctaacttcgtacggaaccctacgtccgaaccgggacccggggtaaaccccttaaacgtttttacggaacgttacgggaaccgggtacccgttaacctttaacgttttccgtacggttaccgtaaccgtaacggggttacggggaaccgtaggttcggggtaccaaccgttgggacccgtaagtttcccggttacgggggacccgggtaaacgggggtaccgaaacggtcccggttacgggaaccccggtttcccgggttacggggttacccgaacccgggtaacccccgtaaacggggtccccgttaccccggccccccggtttaccgggttacccctaacccggttttccccgg

SEQ ID NO: 439747 - DNA, 507 bp, Homo sapiens
  misc_feature: GZ8MTXP02HXF5X.4.27.C05.1.454.CMB.2.raw
  modified_base (278)..(278): a, c, t, g, unknown or other
  modified_base (305)..(305): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggatcaagtgaggccaggccagtcccctntttagcatgatcggatagaagcgcctnaggatcctgagccgcttctctggatccaactcgtagggaacacagccactctgaccatcagcggaccaatttagatcgagccgactatttctgtctacacgtgggacagtgggactacgtagcgagtcgtcggacggacggaccgaagcctgaccgtcgtcgggtcaggcccgaacgcgtcgccccgtcggtccacgttccg

SEQ ID NO: 439748 - DNA, 518 bp, Homo sapiens
  misc_feature: GZ8MTXP02G0G8L.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcggatagaagcggccctgagggatccctgagccgcttctctggactccaactcgtagggaacacgagcccactctgacccatcagcgggaccctaacgtttagatgaggccgactattactgtcacgacgtgggacagtgggcacgtgcgtatcgttcggcggacggacaagcgtacgaccgtcgtcggtcacgcccgaaggcctcgccccgtcggtctacgttccg

SEQ ID NO: 439749 - DNA, 591 bp, Homo sapiens
  misc_feature: GZ8MTXP02I1EXS.4.27.C05.1.454.CMB.2.raw
  modified_base (246)..(246): a, c, t, g, unknown or other
  modified_base (278)..(278): a, c, t, g, unknown or other
  modified_base (401)..(401): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactcgtccgtcgtccccaggacagacacgccaccattacctgctctaggaatgaattggcagataagttgngtgtggtatcaagtgagcaggccagtcccctntttagctatgtatcggatagaaagccgcctcgagggactccctgacgccgtcttctctggactacccaactcgtagggaacacacgccactctcgaccatcgagccgggaccctaagtttagngtagacggcccgtattactttcgtgttaccacgtacggttcgggaactaagtcgggctacgtggacgtacgttcgttcggggacgggaacgggacccgaaaggtccgtacggtaacccgttccggtcggggtaccaacggccccgaacggtccgttcccggcccccgttcggtacctaaccgtttccccg

SEQ ID NO: 439750 - DNA, 696 bp, Homo sapiens
  misc_feature: GZ8MTXP02JT7GN.4.27.C05.1.454.CMB.2.raw
  modified_base (214)..(214): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagttgtgtgtgtatcaagtgagccaggccagtcccctntttagcatgtatcggatagaagcggcctgagggactccgtgacgccgtcttctctggactccaactcgtagggaacacgacgccactcgtacgaccagtaccgacggtaccgggacccttaaacgtttttacgacgttcgggaacggtacccgtaactttacgtttaccgtacggttaccgtaaccggtaccggttacggggaacccgtaaggttcgggggacctaaccggttcggaccggttaacgtttcccggttaccgggggaccgggggtaacggggtaaacccgaaacgggtccgttaccggggaaccccggttcccggtacgggggttaacccgaccgggtaacccccggaaacgggtccccgttacccgggtacccccccgtttccggggttacccctacccgtttccccgg

SEQ ID NO: 439751 - DNA, 566 bp, Homo sapiens
  misc_feature: GZ8MTXP02F99JE.4.27.C05.1.454.CMB.2.raw
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgttgttggtatcaagtgaggccaggccagtcccctntttagcatgtatcggatagaagcgcctgaggactcctgagccgcttctctggatcccaaactcgtagggaaaccacgacgcccaactctacgaccatcgacgaccgggaaccctaaacgttttacgattacggacggccgtaactactttactcgtacacgacgtcgggacagtcgggacacgtgcgagtcgttcggacggacgggaccaaggccgtcgaccgtccgtcgggtaccacggaacccgaacggtccgtccggcccccgtcggtccctaccttcccg

SEQ ID NO: 439752 - DNA, 579 bp, Homo sapiens
  misc_feature: GZ8MTXP02GOJ6J.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctnttttagcatgtatcgggatagaagcggccctgagggactccctgagcccgtcttctctggactcccgaaacttccgaggggaaacacgacgccctaactctgaaccatccgacgaccggggaaccctaaacgttttacgattaggaacggtaccgacttactttacgtacgtacacgacggttgggaacgagtagggcacgtgcgtaatcgttcgggacggacgggaccgaaacgcgtacggacccgtcgtcgggtaccacgcccgaaacgggcctacgcccccgtcggccacttcccg

SEQ ID NO: 439753 - DNA, 511 bp, Homo sapiens
  misc_feature: GZ8MTXP02HKYZD.4.27.C05.1.454.CMB.2.raw
  modified_base (214)..(214): a, c, t, g, unknown or other
  modified_base (246)..(246): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagtttgngtgtggtatcaagtgaggccaggccagtcccctntttagcatgtatcggatagaaagcggcctgagggactcccgtgacgccgtcttctctggatccaactcgtagggaacacagccactctcgaccatcacgccgggaccctaacttttagatgagccgactattctgtcacgtagtggacgagtgggacacgtgcgatcgtcggcggtacggacagctcgaccgtcgtcggtcacgccgagcctcgcccctcggctactcccg

SEQ ID NO: 439754 - DNA, 657 bp, Homo sapiens
  misc_feature: GZ8MTXP02FWGZ0.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagtttgtgtgttggtatcaagtgagccaggccagtcccctntttagcatgtatcggatagaaagcggccctgagggactcccgtgacgccgcttctcgtggactcccaaactcgtaggggaaactacaacgcccaactctacgaacccatcgacgaccgggaccctaaacgttttacgacttacggacggacccgtaacttacgtttaccgtacgttaccgaaccgtaacggtacggggtaaccgtagttacgggggacctaacgttcggaccggtaacgttccggtttaccggggaccgggaacggggaacccgtaaaggccgtacgggtaacccggttcccgtacggggtacccaaccggaaccccgaaacggacccgtacccggaccccccgttccgggtaccctaccgtttccccg

SEQ ID NO: 439755 - DNA, 579 bp, Homo sapiens
  misc_feature: GZ8MTXP02G3CLM.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgtggtatcaagtgaggccaggccagtcccctntttagcatgtatcggatagaagcgcctgagggatcccgtgacgcccgtcttctctggactccgaactcgtagggaacacgacgcccaactctacgaccatccgacgccgggaccctaaacgttttagacgttggacggtaccgtacttagtttactcgttacgacgtacggtagggactagtgggaccacgtcggcgtagtccgttcggggacggtaacgggaccaaggccgtacggacccggtccgtcgggtccacggcccgaacggccgtccgcccccgtcggtcccacgtttcccg

SEQ ID NO: 439756 - DNA, 671 bp, Homo sapiens
  misc_feature: GZ8MTXP02FWDXE.4.27.C05.1.454.CMB.2.raw
  modified_base (276)..(276): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgtgtatcaagtgagccaggccagtcccctntttagcatgtatcggataggaaagcgccctgaggactccctgacgcccgtcttcctctcggactccaaacttcgtacgggaaacacgacgcccaactctacgaacccataccacggaccgggtaaccctaaacgttttaagacttaggaacggtaccgtaacttaacgtttccgttacggtacctaaccgtacgggttacggggaaccgtaagtcggggacctaacgtcggacgtaacgttccggtttaccggggaccgggtaacggggaaacccgtaaacggtccgtaccggtaacccggttccggttacggggtacccgaaccggtaacccccggaaaacggtcccgttacccggcccccccgtttaccgggtaccctaacccggtttccccg

SEQ ID NO: 439757 - DNA, 603 bp, Homo sapiens
  misc_feature: GZ8MTXP02HR42D.4.27.C05.1.454.CMB.2.raw
  modified_base (214)..(214): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagatagttgtgtgtggtatcaagtgaggccaggccagtccccttntttagtcatgtagtcggataggaagcggcctgagggactcccgtgacgccgtcttctcgtggactcccaatcgtagggaaacacgacgccactctacgaccatccgacgaccgggaaccctaacgttttagacgttacggacggccgtacttactttcgtacgttccaacgtacggtagggacgagtcggggactacgtcggacgtacgttccggttacgggcgggaacgggacccgaaaggtccgtacggtacccgtccggtacggggtaccgacggaacccgaacggcccgtccggcccccgtcgggtcctaccgtttcccg

SEQ ID NO: 439758 - DNA, 627 bp, Homo sapiens
  misc_feature: GZ8MTXP02JUO73.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgttggtatcaagtgaggccaggccagtcccctntttagcatgtatcgggatagaaagcggcctgagggactccctgagcccgcttctctggactccaactcgtagggaaccacgagcccactctgacccatcgacgccgggaccctaacgttttagatagacggccgactatttctcgtccaacgtacggttgggacagtcgggacctacgtcggacgtacgtcggttcgggacggggtaacggggaccccgtaaagggtcccgtacgggtaacccggttcccggtacgggggttaccgaacgggtaacccccgtaaaagggggccccgttacccgggtccccccccggttcggggttaaccccgtaccctttcccccgg

SEQ ID NO: 439759 - DNA, 520 bp, Homo sapiens
  misc_feature: GZ8MTXP02HU28X.4.27.C05.1.454.CMB.2.raw
  modified_base (279)..(279): a, c, t, g, unknown or other
  modified_base (309)..(309): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcggatagaaagcggcctnagggatcccgtgacgccgcttctctggatcccgaactcgtagggaaacacgacgccactctacgaccatcagcggaccaacgtttagatagaggccgatattactgtacacgtacgtgggacagtgggacacgtgcgtatcgtcggcggacgggacaaagctaggaccgtcgtcgggtcacgccgaaggctcgccccgtcggtcacttccg

SEQ ID NO: 439760 - DNA, 675 bp, Homo sapiens
  misc_feature: GZ8MTXP02IF1FH.4.27.C05.1.454.CMB.2.raw
  modified_base (278)..(278): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgttggtatcaagtgaggcaggccagtcccctntttagcatgtatcggatagaagcgccctgaggactccgtgacgcccgtcttctcgtggactccaaacgtctagggaaacacgacgcccactctacgacccatccgacgccgggtaaccctaaacgttttacgactacggacggacccgtactttacgtttctagttaccgacgtacgggtcgggaaccgaagttcggggacctacgtcggtaccgtacgttccggtttaccggggaccggggtaaacggggaacccgaaacgggtccgttaccggggaacccccggtttcccggttaccgggggttaccccgaaccgggtaaccccccggaaacggggtccccgttaccccgggaccccccccgtttaccgggttcccctaaccccgtttcccccgg

SEQ ID NO: 439761 - DNA, 551 bp, Homo sapiens
  misc_feature: GZ8MTXP02H3KYD.4.27.C05.1.454.CMB.2.raw
  modified_base (185)..(185): a, c, t, g, unknown or other
  modified_base (275)..(275): a, c, t, g, unknown or other
  modified_base (317)..(317): a, c, t, g, unknown or other
  modified_base (375)..(375): a, c, t, g, unknown or other
  modified_base (450)..(450): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtntccccaggacagacagccaccattacctgctctggaaatgaattggcagattaagttgtgtgtgtatcaagtgagcaggccagtcccctntttagctatgtatcggatagaagcgccctgagggactcccgnggacgccgcttctcgtggactccaactcgtagggaacacgacgccactctacacctancgacggtaccggaaccctaacttttagacgtagacggacctacttacttcgtgtactacgtacggtagggaacgnggtcgggactacgtggacgtagttcggtacgggcggacggaccgtagcgtcgaccgtcgtcggcgacgccgacggcctccgccccgtcggacctcgtcccg

SEQ ID NO: 439762 - DNA, 573 bp, Homo sapiens
  misc_feature: GZ8MTXP02HCUDF.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagttgtgtgttggtatcaagtgaggccaggccagtcccctntttagctatgtatcggatagaagccggacctgacggtactcccgtgacgcccgtcttcctcgtggactaccaactcgtacgggaaacacgacgcccactctacgacctatccgacgacgggaccctaagtttagagtagacggtaccgtacttattctagttccacgtacgtggactagtcggacagtcgacgtatccgtcgggcgggacggaccgaagtccgtacggaacccggtccgtacggggtccacggcccgaacggtcccgtcgcccccggtcggtaccaccgttcccg

SEQ ID NO: 439763 - DNA, 686 bp, Homo sapiens
  misc_feature: GZ8MTXP02JNVF9.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgttggtatcaagtgaggccaggccagtcccctntttagcatgtatcggatagaagcgcctgaggactccgtgacgccgtcttctcgtggactccaactcgtagggaaacacgacgcctactctacgaccataccgacggaccgggtaaccctaaacgttttagacgtacggaacggtacccgtactttaacgttttccgtacgttaccgaaccgtaccgggttacggggaacctaaggttcggggacctaaccggttcggaccggtaacgttccgggttacggggaccggggtaaacggggaacccgaaacgggtcccgttaccgggaaccccggttcccgggtacggggttaccccgaaaccggaacccccggtaaacggggtccccgttaccccgggtcccccccgtttaccggggtccccttaccgtttcccccgg

SEQ ID NO: 439764 - DNA, 595 bp, Homo sapiens
  misc_feature: GZ8MTXP02JPVLX.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggacagattaagttgtgtgttgtatcaagtgagccaggccagtccccttntttagcatgtatcggatagaacgccggcctgaggtactcccgtggacgtcccgtctttcgtcgtcggactacccgaacttcggtacgggaaacaccgacgaccacttcacgaccatccgacggaccgggtaacccttaaacgttttagacgtacgggaacggtacccgtaactttacgtttccgtcgtaccgaaccgtacggggtacggaacgtacgtcggacctacgtggactacgtcgtcgggacggtacggacaggcgtacgccgtcgtacggtcacgccgacgccgtccgcccgtcggtacctcgtcccg

SEQ ID NO: 439765 - DNA, 702 bp, Homo sapiens
  misc_feature: GZ8MTXP02G8FBF.4.27.C05.1.454.CMB.2.raw
  modified_base (214)..(214): a, c, t, g, unknown or other
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtattaagttgtgtgttggtatcaagtgaggccaggccagtcccctntttagcatgtatcggatagaagccgcctgagggtactcccgtgagcccgtcttctcgtggactccaactcgtacgggaaacacgacgccctaactccgtacgaacccagtaccgaacggtacccgggggtaaaccccttaaacgtttttacggacgttacggtaaccggggtacccgtaaacgtttactttttccgtacggttaccgtaaaccggttacgggtacgggggtaacccgtaaggttcgggggaccctaacggtttcgggaccggttacgtttccgggtttaccgggggaccgggggtaacgggaacccgtaaacgggtcccgttacggtaaccccgggttccggtacggggtccaccgggaaccccgaacggtccgtacccggcccccgttcggtcccgtacctttccccgg

SEQ ID NO: 439766 - DNA, 658 bp, Homo sapiens
  misc_feature: GZ8MTXP02GR9QC.4.27.C05.1.454.CMB.2.raw
  modified_base (289)..(289): a, c, t, g, unknown or other
  modified_base (350)..(350): a, c, t, g, unknown or other
tcagagcactgtagcacgaccggtgctcgatttagacgcgatcgaagggtttggggctgggcctcaggaagcagcatcgggaggtgcctcagccatggcatggatccctctcttcctcggcgtccttgcttactgcacaggatgcgtgacctcttatgagctgactcagcccaccctcactgtccgtcgtccccaggacagacagcccaaccattacctgctctaggaaatgaattggcagattaagtttgtgtgttggtatcaagtgaggccaggccacgtccccttnttttagctatgtagtcggataaggaagccggcctgagggactcccgtgagcccgtcttccngtggactcccaacttcgtagggaaacacgacgccctaacttcacgacccataccgacggaccgggtaaccctaacgttttagacgttagacggaccgtacttacgtttacgtcgttaccaacgtacggtacggggaacctaggtcgggtccgaacgtcggacgtacgttccggttccggggacgggaacgggtaccccgaaaggtccgtaccggtacccggttcccggtacggggttaccgaaccggaacccggaaacgggtcccgtcccggtaccccccgttaccggtccctaacccggtttccccg

SEQ ID NO: 439767 - DNA, 763 bp, Homo sapiens
  misc_feature: GZ8MTXP02HULYS.4.27.C05.1.454.CMB.2.raw
  modified_base (152)..(152): a, c, t, g, unknown or other
  modified_base (274)..(274): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagccaccctcactgtccgtgtccccaggacagacagccaccattacctgctctaggaaatgaattggcagatagttgtgtgtgatcaagtgagcaggccagtcccctntttagcatgtagtcggatagaagcgcctcgagggactcccgtgacgtcccgctttctcgtacggacttaccccaacgttccgtacgggggaaaccaccgaccgtaccctacccgtacttaccgaaaccctaacgtacccgaacgggtacccggggtaaaccccttaaaccgtttttaaggacgtttacgggaaccggtacccgtactttaacgttttccgttacggttaccgtaaacggtaccgggttagggggaaccaacgggtttcgggggacctaaccgtttcgggaccgggttaacgttcccggtttacgggggacccggggttaaacgggggtaaccccgtaaagggcccgtttaccggtaaccccgggtttcccggtacgggggttaccccgaaccggggaaccccccggttaaacggggacccgttacccccggggtacccccccgttacccggggtttccctaaccccgttttcccccggg

SEQ ID NO: 439768 - DNA, 665 bp, Homo sapiens
  misc_feature: GZ8MTXP02FO4GO.4.27.C05.1.454.CMB.2.raw
  modified_base (278)..(278): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagtttgtgtgttgtatcaagtgagcaggccagtcccctntttagcatgtatcggatagaagcgcctgaggactccgtgacgcccgtcttcgtctggactcccaacttcgagggaacacgacgccctaactcgtacgaaccataccgacgaccgggtaaccctaaacgttttagacgttacggaacggtacccgtaacgttaacttttaccgttcggtacctaacggtaccggttacggggaaccgtaaggttccggggtaccaaccggttcggaccggtaacgttaccggtttccgggggaccgggtaacggggaaccccgtaaaggcccgttacgggaacccggttccggttacgggtaccgacggtaaccccgaaacggtcccgtcccggtacccccgtaccgggtacccgtaccctttccccg

SEQ ID NO: 439769 - DNA, 754 bp, Homo sapiens
  misc_feature: GZ8MTXP02GTR71.4.27.C05.1.454.CMB.2.raw
  modified_base (283)..(283): a, c, t, g, unknown or other
  modified_base (364)..(364): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagtataagtttgtgtgttggtatcaagtgaggccaggccagtcccctntttagcatgtatcggatagaagcggcctgaggactccctggagcccgtcttctcgtaggactccgaactcgtagggaaacncgacgcccactcacgaccatccgacgccgggtaaccctaacgttttacgacgttacggaacggtacccgtaacgttaacttttccgttacgttaccgtaaccgtacgggttacggggtaaccgtaacggttaccgggggacctaaccggttcgggtacccggtaaacgtttcccgggtttaaccgggggtacccgggggtaaacgggggtaaaccccgaaaacggggtccccggtttaaccggggtaaacccccgggtttaccccgggttcgggggttaccccgaaacccggggtaacccccggtaaaacggggtcccccgtttcccccggggtaaccccccccggtttcccggggtttaacccccgttaaccccggttttccccccggg

SEQ ID NO: 439770 - DNA, 525 bp, Homo sapiens
  misc_feature: GZ8MTXP02I1COP.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttggtatcaagtgaggccaggccagtcccctnttttagcatgtatcggatagaaagcggccctgagggatccccgtgacgccgcttctctggatcccaactcgtagggaacacagccactctgaccatcagcggaccaatttagatgagccgatattctgtcacgacgtgggacagtcgggctacgtgcgatcgttcgggacggacggaccaagcgtacgacccgtcgtcggtcacgaaccgaacggcctccgcccccgtcggtccgtacttcccg

SEQ ID NO: 439771 - DNA, 619 bp, Homo sapiens
  misc_feature: GZ8MTXP02JCL74.4.27.C05.1.454.CMB.2.raw
  modified_base (214)..(214): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagattaagttgtgtgttggtatcaagtgaggccaggccagtcccctntttagcatgtatcggatagaaagcggcctgagggatcccgtgacgccgtcttctctggactccaactcgtagggaaaccacgacgcccactctcgacccagtcacggccgggaaccctaagttttagagttgacggaccgtacttactttctggttaccacgtaccgttgggaacctaagtcggggacaacgtggacgacgttcgtttaccggggaccgggtacgggaacccgaaaggtccgtacggtaaccccggtccggtcggggttaccaacggcccccgaaaaggggccccttacccggccccccgttccggggtaccctaaccgtttcccccg

SEQ ID NO: 439772 - DNA, 539 bp, Homo sapiens
  misc_feature: GZ8MTXP02GOYTJ.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttggtatcaagtgaggccaggccagtcccctntttagcatgtatcggatagaaagcggcctgaggactccgtgacgccgcttctctggactaccaactcgtagggaacacgacgcccactctcgaccatcacgaccgggaccctaacgtttagattcgacggtaccgacttattctcgtcacgtacgtgggacgagtcgggcacgtgacgtagtcgtcggacggacgggacagcgtcgaccgtcgtcggtacacgcccgacggcctcggccccgtcggtccacgttcccg

SEQ ID NO: 439773 - DNA, 564 bp, Homo sapiens
  misc_feature: GZ8MTXP02FNINM.4.27.C05.1.454.CMB.2.raw
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagataagtttgtgtgttggtatcaagtgaggccaggccagtcccctnttttagcatgtatcggatagaagcggcctgagggactccgtgagcccgtcttctctggactcccaactcgtaggggaaacacgagcccactctcgaccatcacgacggaccctaacgttttagatgacggccgtacttactttctcgtacacgtacggtgggacagtcgggacacgtgtcgagtcgttcgggcggtacgggaccaaggccgtacggtacccgtccgttcgggccaacggcccgaacggccgtcccggcccccgtccggtcctactttccccg

SEQ ID NO: 439774 - DNA, 620 bp, Homo sapiens
  misc_feature: GZ8MTXP02GHE0P.4.27.C05.1.454.CMB.2.raw
  modified_base (213)..(213): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctaggaaatgaattggcagtataagttgtgtgtggtatcaagtgagcaggccagtcccctntttagcatgtagtcggataggaacgcggcctcgagggactccgtgacgcccgtcttctcgtggactaccaacgtcgtacgggaacacgacgccactctagaccataccgacggaccgggtaacccttaagttttacgacgttacggacggtacccgtaacttacgtttccgtacgtaccgtacgtacggtcggggaacctaggttcgggactacgtcgacgtacgtccggttacggggacgggtaacgggaccgaaggtccgtacggtacccggtccgtacgggtaccaccggtaacccgaacggtcccgtccggtcccccgtcggtccctaccgtttcccgg

SEQ ID NO: 439775 - DNA, 646 bp, Homo sapiens
  misc_feature: GZ8MTXP02INGO1.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctaggaaatgaattggacagtattaagtttgtgttgttggtatcaagtgaggcaggccacgtcccctntttagctatgtatcggatagaacgcggcctgaggactcccgtgacgccgtcttctcgtggactccaactcgtaggaacacgacgccatctcgacatccgagaccggaaccttaacgtttagacgttacggacggtacccgtaacttacgttttccgttacgttaccaacggtaccgggttacggggtaacctaacgggttcggggacctacggtcggtaccggtactttccggttcggggaccggggtaacggggaccgtaaaggccggttacggaacccgttccgggttacggggtccaaccggaacccgtaaacggcccgttacccggtcccccgttcgggtaccctaaccgtttccccg

SEQ ID NO: 439776 - DNA, 686 bp, Homo sapiens
  misc_feature: GZ8MTXP02IEWNH.4.27.C05.1.454.CMB.2.raw
  modified_base (281)..(281): a, c, t, g, unknown or other
  modified_base (333)..(333): a, c, t, g, unknown or other
  modified_base (357)..(357): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagattaagttgtgtgttggtatcaagtgaggccaggccagtcccctntttagcatgtatcggatagaagcgcctgaggactccgtgacgcccgtcttcncgtgactccaactcgtaggaaacncacgcccacgtctacgaacctatacgaacggaccgggtaaccctaaacgtttttagaacgttacggaacgggtacccgtactttaactttcgtacgttaccgaacgtaccgggttagggaaccgtagtcggggacctaacggtcggtaccggtaacgttcccggttacggggaccggggtaaccggggtaacccgaaacgggtccgttaccggggtaaccccggttcccggttacgggggttacccgaaccggggtaacccccgaaacggggtccccgtacccggtacccccccgtttaccggggttcccgttaaccctttccccccgg

SEQ ID NO: 439777 - DNA, 697 bp, Homo sapiens
  misc_feature: GZ8MTXP02GB6BP.4.27.C05.1.454.CMB.2.raw
  modified_base (256)..(256): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagttgtgtgttgtatnaagtgagccaggccagtcccctntttagcatgtatcggatagaagcgcctgaggactcctgacgcccgtcttctctggactccaactcgtagggaaacacgacgcctaactctacgaaccctataccgacggaccgggtaaccccttaaacgtttttacgaacgttacggtaacgggtacccggttaaacctttacgttttccgttacggtttaacccaacccggtaaccgggttacgggggtaaccgtaacggtcgggggtaccttaacggttcggtaccggtaacgtttccggtttaccgggggaccggggaaacgggggtaaccccgaaagggcccgtacgggtaaccccggtccggttaccggggtaccgaaccggaaccccggaaacgggcccgttcccggtcccccccggtacgggttcccacccgtttccccgg

SEQ ID NO: 439778 - DNA, 664 bp, Homo sapiens
  misc_feature: GZ8MTXP02JWBIZ.4.27.C05.1.454.CMB.2.raw
  modified_base (214)..(214): a, c, t, g, unknown or other
  modified_base (281)..(281): a, c, t, g, unknown or other
  modified_base (331)..(331): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagttgtgtgttggtatcaagtgagccaggccagtccccttntttagctatgtatcgggataaggaacgccggccctagacgggactcccgnggacgtcccgtcttcgtcgtcggactccaacgttcgtacgggaaacacgacgccctactcgtacgaccacgtacgacggtaccgggtaaccctaacgttttagacgtacggaacggtacccgtacgtttactttacgtcgtaccgtacgtacggtagggacgtagtcgggactacgtcggcgtacgtcggttacgggcgggaacgggaccgtaacggtcgtaccgggtaacccggttccgggttaccggggttaccgaaccggtaaccccggtaaacgggtccccggtacccggtcccccccggttacggggttccctacccgtttcccccgg

SEQ ID NO: 439779 - DNA, 698 bp, Homo sapiens
  misc_feature: GZ8MTXP02HKJR8.4.27.C05.1.454.CMB.2.raw
  modified_base (214)..(214): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagtttgtgtgtggtatcaagtgaggccaggccagtcccctntttagcatgtatcggatagaagcggcctgaggatccctgagccgcttctctggactaccaactcgtagggaaacacgacgccctaacgtcttacgaacctataccgaacggacccggggtaaaccctaaaccgttttaagtaacgttacggaacggtacccggtaaccttacgtttaccttcgttaccgtaaccgtaaccgggttacggggaacgtaaacggtcggggtacccacgttacgggaccgtaagttccggttccgggggtaccgggaacgggggaacccgaaacgggtaccggttccggaaacccgggttccccggttcgggggtacccgtaaccgggaacccgaaaccggggttacccgtcccccgggtaccccccgtttcccggggtacccgttaaccctttcccccggg

SEQ ID NO: 439780 - DNA, 524 bp, Homo sapiens
  misc_feature: GZ8MTXP02JHOFA.4.27.C05.1.454.CMB.2.raw
  modified_base (280)..(280): a, c, t, g, unknown or other
  modified_base (308)..(308): a, c, t, g, unknown or other
  modified_base (330)..(330): a, c, t, g, unknown or other
  modified_base (409)..(409): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaagcgcctnagggatcccgtgagccgcttcnctggactccaactcgtgggaacacagccactctgaccatcagcggaccctaatttagatgagccactatttctgtcacncgtgggacagtgggcacgtgcgtactcgtcgggcggacgggaccaaggtccgtacggacccgtccgtcggggtaccacgcccgaaggcctcggcccccgtcggtccacgttcccg

SEQ ID NO: 439781 - DNA, 554 bp, Homo sapiens
  misc_feature: GZ8MTXP02HQPNF.4.27.C05.1.454.CMB.2.raw
  modified_base (277)..(277): a, c, t, g, unknown or other
  modified_base (434)..(434): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgtggtatcaagtgaggcaggccagtcccctntttagctatgtatcggatagaaagcggccctgagggactcccgtgacgcccgcttctctggatcccaactcgtagggaacacgacgccactctcgaccatcgacgaccgggaccctaacgttttagactgacgccgtactatttctgtcacgtacgnggacagtcgggcacgtgcgacttcgtcgggcggacgggaccaaggccgtacggacccgttccgcgggtccgacggtcccgaacggccgtccggcccccgtcggtaccgtaccgtttcccg

SEQ ID NO: 439782 - DNA, 638 bp, Homo sapiens
  misc_feature: GZ8MTXP02JLT9U.4.27.C05.1.454.CMB.2.raw
  modified_base (285)..(285): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtcgtccccaggacagacacgccaccattacctgctctaggaaatgaattggcagtattaagtttgtgtgttggtatcaagtgagccaggccagtcccctntttagctatgtatcggatagaagcgcctgaggactccgtgacgccgtcttctctggactaccaactcgtacgggaacacgacgcctactctacgaccagtaccgacggaccgggaacccttaaacgttttagacgtacggacggtaccgtacgtttactttcgtacgttaccgaaccggtacggtagggacctaggtcgggacctacgtggcgtacgttccggttacggggacggggtaacgggaccgaaacggccgttaccgggtacccggttccggtacggggtaccgaaccggtaaccccgaacggtccccgtacccggtcccccgtcggttaccctacccgtttccccg

SEQ ID NO: 439783 - DNA, 520 bp, Homo sapiens
  misc_feature: GZ8MTXP02FHCI9.4.27.C05.1.454.CMB.2.raw
  modified_base (279)..(279): a, c, t, g, unknown or other
  modified_base (314)..(314): a, c, t, g, unknown or other
  modified_base (336)..(336): a, c, t, g, unknown or other
  modified_base (344)..(344): a, c, t, g, unknown or other
  modified_base (394)..(394): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctggaaatgaattggcagataagtttgtgtgttggtatcaagtgaggccaggccagtcccctnttttagcatgtatcggggatagaaaagcggccctnagggatccctgagccgctttcncgtagacnccaactcaggaacacagcctactctgaccatcacgacggacctaacttanatgacgcgactacttctgtcacacgtggacgagtcggcgactcgcgagtcgtcggcggacggacgacgcgtcgaccgtccgtcggtcgacgaacccgacgacgtccgccccgtccgtccgtctccg

SEQ ID NO: 439784 - DNA, 702 bp, Homo sapiens
  misc_feature: GZ8MTXP02JEHDQ.4.27.C05.1.454.CMB.2.raw
  modified_base (213)..(213): a, c, t, g, unknown or other
  modified_base (282)..(282): a, c, t, g, unknown or other
  modified_base (323)..(323): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctaggaaatgaattggacagataagtttgtgtgttggtatcaagtgaggccaggccagtccccttnttttagcatgtatcggataggaagccgcctgaggatcccgngacgccgtcttctcgtggactaccaactcgtagggaaaccacgacgacccactactacggacccatccgaacggtacccgggtaaccccttaaagttttagacgttcggaacgggtaccgtaacgttattttaccgtacgttaccaacgtacggttacgggaacctaaggtcggggacctacggttacggtcgtaacgttcccgggttacggggaccgggtaaacgggggaacccctaaaacggggtcccgttaccgggtaaacccccgggtttcccggttacgggggtaccccgtaaccggaacccccgaaacggggtcccccgttaccccggggtacccccccgttaccggggtttcccctaaccggttttcccccg

SEQ ID NO: 439785 - DNA, 708 bp, Homo sapiens
  misc_feature: GZ8MTXP02HNNXV.4.27.C05.1.454.CMB.2.raw
  modified_base (214)..(214): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagttgtgtgttggtatcaagtgaggccaggccagtcccctntttagtcatgtatcggataggaaagcggcctgagggactcccgtgagccgcttctctggactccaatcgtagggaacacgagccactctcgacccatcgacggaccgggaacccttaaacgttttagacgttacggacggtacccgtacttaacttttccgtacggttaccgaaaccgttaccgggttacgggggaaccctaaggttcgggggaccctaacgtacgggtccggtaacgtttcccgggtttaccgggggaccggggtaaaccgggggaacccgtaaacgggtcccgtacggggttaacccccgggttacccggttcgggggttaccccaaccgggaacccccggtaaacggggtcccccgttaccccggggtaccccccccgtttccggggttaccccttaaccccggttttcccccgg

SEQ ID NO: 439786 - DNA, 660 bp, Homo sapiens
  misc_feature: GZ8MTXP02GU2K0.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgagccaggccagtcccctntttagcatgtatcggatagaaagcggcctgaggatcctgagccgtcttctctggactccaactcgtagggaaacacagcccactctcgaccatcgacgaccgggaaccctaaacgtttttacgacttacggaacggtaccgtaacttacttttaccgtcgttaccaacgtacggttacgggaaccgtaggttcgggggacctaccgttacggccggtaacgttccggtttccggggaccggggtaacggggaacccgaaacggtcccgtacgggaaccccggttcccggttaccgggggtaccgaaccgggaacccccgaaacggggtccccgttacccggacccccccgttccggggtacccctaacccgtttcccccgg

SEQ ID NO: 439787 - DNA, 512 bp, Homo sapiens
  misc_feature: GZ8MTXP02G4V6J.4.27.C05.1.454.CMB.2.raw
  modified_base (274)..(274): a, c, t, g, unknown or other
  modified_base (316)..(316): a, c, t, g, unknown or other
  modified_base (367)..(367): a, c, t, g, unknown or other
  modified_base (412)..(412): a, c, t, g, unknown or other
  modified_base (417)..(417): a, c, t, g, unknown or other
  modified_base (433)..(433): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctaggaaatgaattggcagataagttgtgtgtgtatcaagtgagcaggccagtccctntttagcatgatcggatagaaagcggccctgagggactcccgngagccgtcttctcgtggatccaaacttcgagggaaacacacgccactctanaccatacagaccggacctaactttagatgacggcactattctctnacagngggacagcggcgacgngcgagtcgtcggacggacggacgacgacgacgaccgtcgtcggcgacgaaccgacgcgtccgcccgtccgtcctactcg

SEQ ID NO: 439788 - DNA, 547 bp, Homo sapiens
  misc_feature: GZ8MTXP02F6GET.4.27.C05.1.454.CMB.2.raw
  modified_base (214)..(214): a, c, t, g, unknown or other
  modified_base (275)..(275): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagatagttgtgtgtgtatcagtgaggcaggccagtcccctntttagcatgtatcggatagaagcggcctgaggatcccgtgagcccgtcttctctggactcccaactcgtagggaacacgacgcccactctacgaccatcgacgaccgggaccctaaacgttttagataggacggtaccgtacttactttacgtcgttaccacgtacgtgggacgagtcgggacacgtgcgtatcgtcgggcggacgggaccgagcgtacgaccgtccgtcggtcacggcccgaacggcctcggcccctcggtcctacgtccg

SEQ ID NO: 439789 - DNA, 525 bp, Homo sapiens
  misc_feature: GZ8MTXP02GOAML.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataaagtttgtgtgttggtatcaagtgaggccaggccagtcccctnttttagcatgtatcggatagaaagcggcctcagggatccctgacgccgtcttctctggactcccaactcgtgggaaaccacagcccaactcctgaccatcagcggacccaactttagatgacgcgacttatttctgtcacacgtgggacagtcgggcacgtgcgatcgtcgggcgacgggaccaaaggctacggaccgtccgtcgggtcaacgcccgaaggctcggccaccgtcggtactaccg

SEQ ID NO: 439790 - DNA, 506 bp, Homo sapiens
  misc_feature: GZ8MTXP02H34HL.4.27.C05.1.454.CMB.2.raw
  modified_base (174)..(174): a, c, t, g, unknown or other
  modified_base (273)..(273): a, c, t, g, unknown or other
  modified_base (306)..(306): a, c, t, g, unknown or other
  modified_base (353)..(353): a, c, t, g, unknown or other
tcagagcactgtagcacgaccggtgctcgatttagacgcgatcgaagggttgggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccacattacctgctctggaaatgaattggcagataagttgtgtgttggatcaagtgagcaggccagtcccctntttagcatgtatcggatagaaagcggtaccctnagggactcccgtgagccgcttctctggatccaactcgtagggaaacncagccactctgacccatcagcggaccaacttttagatgagccgatacgttctgtcacgtacgtgggacagtgggcacgtgcgtatctcgggcgaggaccaggctcgaccgtcgcggtacacgcccgaaggcctccgccctaccggtcactccg

SEQ ID NO: 439791 - DNA, 651 bp, Homo sapiens
  misc_feature: GZ8MTXP02G5SGN.4.27.C05.1.454.CMB.2.raw
  modified_base (214)..(214): a, c, t, g, unknown or other
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggacagtattaagtttgtgtgttggtatcaagtgagcaggccagtcccctntttagctatgtatcggataggaacgcgcctgaggactccctggacgcccgtcttcgtctaggacttcccgaaacttcgtacgggaaacacgacgccctaactcgtacgaacctacgtaccgaacggaccgggtaaaccctaaacgttttaaggacgtacggaacggtacccgtaactttaacgtttcgtacgttaccgaaccgtacgggtacgggtaaccgtaggttccggggactacggttacggacggttaacgttccggttacggggacggggtaacggacccgaaaggtccgtacggtacccgtccggtacggtccgaacggaaccgaacggccgtcccggccccgtacggtcctaccttcccgg

SEQ ID NO: 439792 - DNA, 573 bp, Homo sapiens
  misc_feature: GZ8MTXP02GJ3T1.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgttgttggtatcgaagtgaggccaggccacgtcccctntttagcatgtatcggatagaaagcggcctgagggatcccgtgacgccgtcttctcgtggactaccaactcgtagggaaacacgacgcccaactctacgaccatacgacgaccgggaaccctaacttttagacttgacggccgactatttctagtacacgtacggtaggacagtcgggacacgtgcgactcggttcgggacggacgggaccaaggccgtacggacccggtccgtacggggtccacggaacccgaacggccgtccggcccccgtcggtccaccgtttcccg

SEQ ID NO: 439793 - DNA, 509 bp, Homo sapiens
  misc_feature: GZ8MTXP02F5ENJ.4.27.C05.1.454.CMB.2.raw
  modified_base (280)..(280): a, c, t, g, unknown or other
  modified_base (312)..(312): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctnttttagcatgtatcggatagaaagcggccctnagggatccctgagcccgcttctctggatcccaactctggggaacacagccactctgaccatcagcgggacccaactttagatgagccgatagtttctgtcacacgtggacagtgggcactgcgatcgttcggcggacgggaccaaggctgaccgtccgtacggtcagcccgaaggctcgccccctcggtcacttccg

SEQ ID NO: 439794 - DNA, 509 bp, Homo sapiens
  misc_feature: GZ8MTXP02IM2TG.4.27.C05.1.454.CMB.2.raw
  modified_base (279)..(279): a, c, t, g, unknown or other
  modified_base (308)..(308): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagcatgtatcggatagaaagcgcctnagggatccgtgagccgcttctctggatccaactctagggaaacacagcccactctgaccatcagcgggaccctaactttacgatgagaccgactattctgtcactacgtgggacagtgggcacgtgcgatcgtcggcgggacggaccaagctagaccgtccgcgggtcacgcccgaaggcgtcgcccctcggtccactccg

SEQ ID NO: 439795 - DNA, 623 bp, Homo sapiens
  misc_feature: GZ8MTXP02F0TBS.4.27.C05.1.454.CMB.2.raw
  modified_base (276)..(276): a, c, t, g, unknown or other
  modified_base (316)..(316): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattgacagtatagttgtgtgtgatcaagtgagccaggccagtcccctntttagctatgtatcggatagaacgccgcctgaggctccgngacgccgtcttctgtcggtactaccgaactcgtagggaaactacgacgccctaacgtcacgaaccataccgaacggaccggtaacccttaaacgtttacggaacgttaggaacggtaccgtacgtttaactttccgtagtaccgaccgtacggtacgggaacaggtacgggacctacgtcggacgtagttccggtacggggacgggaacggaccgaacggtccgtaaccggtcccggtccgtacgggtccgaacggaacccgtaacgggtcccgtcccgtcccccggtcggtacctacctttccccg

SEQ ID NO: 439796 - DNA, 526 bp, Homo sapiens
  misc_feature: GZ8MTXP02G7OZC.4.27.C05.1.454.CMB.2.raw
  modified_base (278)..(278): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagttgtgtgttggtatcaagtgaggccaggccagtcccctntttagtcatgtatcggatagaagcggcctgagggatccctgagccgtcttctcgtggactccaactctacggggaacaccgagcccactctcgaccatcacgcgggaccctaacttttagatgacggccgtactatttctgtcacgacggtgggacagtcggcacgtgcgtatcgttcgggcggtacgggacaaggctcggaccgtccgtcgggtcacgcccgaggctcgccaccctcggtcctaccg

SEQ ID NO: 439797 - DNA, 545 bp, Homo sapiens
  misc_feature: GZ8MTXP02G15VU.4.27.C05.1.454.CMB.2.raw
  modified_base (280)..(280): a, c, t, g, unknown or other
  modified_base (412)..(412): a, c, t, g, unknown or other
  modified_base (417)..(417): a, c, t, g, unknown or other
tcagagcactgtagcacgaccggtgctcgatttagacgcgatcgaagggtttggggctgggcctcaggaagcagcatcggaggtgccttagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgtggtatcaagtgaggccaggccagtcccctntttagcatgtatcgggatagaaagcggccctcgagggactcccgtgacgcgccttctctggatccaactcgtgggaacacagccactctgaccatcagccggacctaactttagatgacgacgactattctntcacngtggacagtggcacgtcgacgtacgtcgttcggcgggacggaccgaaaggccgtacggacccggtcgtcgggtaccgacgacccgaacggcccgtccgtcccccgtcggtccacctttccgttccccg

SEQ ID NO: 439798 - DNA, 628 bp, Homo sapiens
  misc_feature: GZ8MTXP02HL42U.4.27.C05.1.454.CMB.2.raw
  modified_base (284)..(284): a, c, t, g, unknown or other
  modified_base (343)..(343): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttacttactgcacaggatgcgtgacctcttatgagctgactcacgccaccctcactgtccgtcgtccccaggacagacagccaccattacctgctctaggaaatgaattggcagattaagttgtgtgttggtatcaagtgaggccaggccacgtcccctntttagcatgtatcgggatagaaacgcgccctgagggactcccgtgacgcgtcctttccncgtcggactccaaaccgttcgtagggggaaaccacacgcccaactcctcgaccatcgacggaccgggaaccctaagtttagattacggacgggtacccgttacttactttcgtacgttccgtaacgtacgggttacgggactaggttacggggaccacgttggaccgtatccggttacgggacgggaacggggaaccgtacggcgtaccggaccgttccggtcgggtaccacggacccgaagggcccgtccgacccccgtcggtccctaccgtttcgttcccccg

SEQ ID NO: 439799 - DNA, 613 bp, Homo sapiens
  misc_feature: GZ8MTXP02IQV56.4.27.C05.1.454.CMB.2.raw
  modified_base (289)..(289): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagcccaccattacctgctctaggaaatgaattggcagtattaagtttgtgttgttggtatcgaagtgaggccaggccctacgtcccctnttttagctagtgtatcgggatagaacgccgaccctgagggactcccgtgacgtcccgtcttctcgtggactccaaactcgtagggaaccacacgaccactctacacctatccgacgaccgggaacccttaacgtttagactcggacggtaccgacttactttcgtagtccgacgtacgggtacggacgaaggttcggaccgtacgtcgacgtagttaccggttcgggaccgggtacgggaccaagtccgtacggtacccggtccgtacggtccgaccgaacccgaacggtccgtcccggccccgttccggtacctaccttcccg

SEQ ID NO: 439800 - DNA, 601 bp, Homo sapiens
  misc_feature: GZ8MTXP02IFM1I.4.27.C05.1.454.CMB.2.raw
  modified_base (281)..(281): a, c, t, g, unknown or other
  modified_base (309)..(309): a, c, t, g, unknown or other
  modified_base (313)..(313): a, c, t, g, unknown or other
  modified_base (320)..(320): a, c, t, g, unknown or other
  modified_base (329)..(329): a, c, t, g, unknown or other
tcagagcactgtagcacgaccggtgctcgatttagacgcgatcgaagggtttggggctgggcctcaggaagcagcatcggaggtgcctcagccatggcatggatcccctctcttcctcggcgtccttgcttactgcacaggatgcgtgacctcttatgagctgactcagccaccctcactgtccgtgtccccaggacagacagccaccattacctgctctaggaatgaattggcagattaagttgtgtgttggtatcaagtgaggccaggccagtcccctntttagcatgtatcggatagaagcgcctnaggntcctganccgtcttcnctggactccaactcgtacgggaaacaccgagcccacgtctcgaccatcgacgccgggtaaccctaaacgttttagacgttacggacggtacccgtacttaacgtttccttaggttaccctaacgtacgggttacgggaaccgtagtcgggacgtaacgttggaccgtaagtccgtttcggggaccggacgggaccgaaggcctacggaaccggttccgtcgggtccacggccgaaacggccgtccggtcccccgtcggtcctaccgttcccg

SEQ ID NO: 439801 - DNA, 579 bp, Homo sapiens
  misc_feature: GZ8MTXP02IY7FK.4.27.C05.1.454.CMB.2.raw
  modified_base (214)..(214): a, c, t, g, unknown or other
  modified_base (243)..(243): a, c, t, g, unknown or other
  modified_base (274)..(274): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagatagttgngtgtgatcaagtgaggcaggccagtcccctntttagcatgtatcggatagaagcggcctgacgggatcccgtgagccgtcttctcgtggactcccaactcgtagggaaacacgacgcccactctacgaccatcgacgccgggaaccctaactttagagttcggacggtacccgtacttaatttcgtaggttaccacgtacggttagggaccgagtcgggacacgtgacgtagttcgtcggggacggtacgggaccaacggtcgtacggaccgtccgtacgggtccaacggcccgtaacggccgtacccggcccccgtcggtacctaccgtttcccg

SEQ ID NO: 439802 - DNA, 634 bp, Homo sapiens
  misc_feature: GZ8MTXP02JQ43O.4.27.C05.1.454.CMB.2.raw
  modified_base (216)..(216): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtcgccccaggacagacagcccaccattaccngctcgtaggaaatgaattggacagtataagtttgtgtgttgtatcaagtgagccaggccagtcccctntttagcatgtatcggataggaaacgccggccctgagggtactccccgtgacgcccgtctttcgtcgtacggactacccgaacgttcggtacgggaaaccaccgacgaccctactctcgaacccatccacggccggaacccttaagtttacgactcggaacggtaccgtaacttcgtttaccgcgttaccgacgtacggtagggaccttagcgggaccacgttcggacgtacgttccggttcgggacgggtaacggaccgtacggccgttacggacccggttccgtacggggaccaccggaacccggtaacggcccgtcccggtcccccgtacggtaccctacgtttcccg

SEQ ID NO: 439803 - DNA, 676 bp, Homo sapiens
  misc_feature: GZ8MTXP02FY5CG.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccaccattacctgctctaggaaatgaattggcagtataagtttgtgtgtgtatcaagtgagccaggcctagtcccctntttagctatgtagtacggataggaaacgccggccctaggacgggtactcccgtggacgtcccgtcttctcgtcggtactcccgaactcggtaagggaaaccacgacgccctaactccgtacgaaccctagtaccgacggtacccgggtaacccttaaacgttttagacgttacggacggtacccgtaacgttactttaccgtacgttaccgaacgtaacgggtcgggtaaccgtaaggtccggggactacggttcgaccggtcgttaccggttcggggaccgggtaacgggtaaccgaaacggtccgtacgggtacccgtccggttcgggaccgtaccggaacccgaacggtcccgtcccggtacccccgttacggtaccctaccgtttccccgg

SEQ ID NO: 439804 - DNA, 726 bp, Homo sapiens
  misc_feature: GZ8MTXP02I2T89.4.27.C05.1.454.CMB.2.raw
  modified_base (283)..(283): a, c, t, g, unknown or other
  modified_base (314)..(314): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtcccgtgtccccaggacagacagccaccattacctgctctaggaaatgaattggcagtataagtttgtgtgttggtatcaagtgaggccaggccagtcccctntttagcatgtatcggatagaaagccgccctnagggactcccgtgacgccgtcttctctggactcccaactcgtagggaacacgacgcccaactctacgaaccctagtccaacggaccggggaaaccccttaaacgtttttaacgacgttacggacgggtacccgtaacttaacgtttccgttacggttaccgaacccgtaaccgggttacgggggaacccgtaaggttaccgggggacctaaccggttcggggacccggtaacgtttcccgggtttacccgggggaccgggggtaaaccgggggtaaccccgaaaacgggtcccggttaccgggtaaccccgggttcccgggttacggggttacccgaaaccgggtaacccccgtaaacggggtcccgttacccgggtccccccgttacgggttccctaacgtttttcccccg

SEQ ID NO: 439805 - DNA, 690 bp, Homo sapiens
  misc_feature: GZ8MTXP02HT9AP.4.27.C05.1.454.CMB.2.raw
  modified_base (214)..(214): a, c, t, g, unknown or other
  modified_base (280)..(280): a, c, t, g, unknown or other
  modified_base (334)..(334): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagttgtgtgttgtatcaagtgaggcaggccagtccccttntttagtcatgtatcggatagaaagcgcctgagggactccctgagcccgtcttcncgtggactccaactcgtagggaaccacgacgaccacgtctacgaccctatccgacggaccggaacccctaaacgtttttaacgaacgttcggaacggtcccgtaacgttaactttccgttacgttaccaacgtacggttaggggaaccgtaaggttcggggactacggttcggaccggtaacgttccggtttaccgggggaccggggtacgggggtaaacccgaaacgggtcccgttacgggtaccccgggttacccggttcgggggttacccgaccggggtaacccccgaaacggggtcccgttacccgggtccccccccgtttaccggggttcccctaacccgttttcccccgg

SEQ ID NO: 439806 - DNA, 588 bp, Homo sapiens
  misc_feature: GZ8MTXP02H1Q9T.4.27.C05.1.454.CMB.2.raw
  modified_base (248)..(248): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagcccaccattacctgctctaggaaatgaattggacagattaagttgngtgttggatcaagtgagcaggccagtcccctntttagctatgatcggataggaacgcggccctgagggactcccgtgactccgtcttcgtctaggactccgaactcgtacgggaaactaccgcgaccctactcgtacgaccatacgagaccggaccctaaacgttttagagtcgaacggaccgtacttaactttcgtacgtccgacgtacggtacggggtacctagttacggtacctacgttacgacgtaacgtcgttcgggacggtaggaccaggctacggaccgtcgcgggtaccacgaacccgaggtcctccgtccccgtcggtcctaccgttcccg

SEQ ID NO: 439807 - DNA, 596 bp, Homo sapiens
  misc_feature: GZ8MTXP02FTV22.4.27.C05.1.454.CMB.2.raw
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacacgccaccattacctgctctggaaatgaattggcagtataagtttgtgtgtggtatcaagtgaggccaggccagtcccctntttagcatgtatcgggataggaacgccggccctgagggactcccgtggacgccgtcttcgtctggactcccgaaactccgtagggaaaccacgacgccactctcgaccatcgacgccggaccctaagtttacgacttgacggtccgtacttattactcgtcaccgtagtcgggtaactagttcggcctacgtcgacgtacgtcggttcgggacgggtacgggacccgaaggtccgttacggaccccgttccgtacgggggtccacggtcccgaaggtcccgtcccggtccccctcgggttacccacgtttcccg

SEQ ID NO: 439808 - DNA, 619 bp, Homo sapiens
  misc_feature: GZ8MTXP02H4H9A.4.27.C05.1.454.CMB.2.raw
  modified_base (258)..(258): a, c, t, g, unknown or other
  modified_base (279)..(279): a, c, t, g, unknown or other
  modified_base (284)..(284): a, c, t, g, unknown or other
  modified_base (323)..(323): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgccaccctcactcgtccgtcgtccccaggacagacagcccacattacctgctcgtaggaatgaattggacagattagttgtgtgttgatnaagtgagcagccacgtccctntttanctatgtatacggataggaaacgcgcctgaaggctcccgngacgcccgtctttccgtcgtaggtacctaccgaacgtcggtacgggaaacacgacgccctacgtctacgaccctagtaccgacggtacccgggtaaacccttaaagtttttaacggacgtacggtaaccggtacccgttactttaacgttttcgtacggttaccgtaacgtacggtacgggacgtagtacgggactacgtgacgtacgtcgtcgggacggtacgacgagtcgtacgaccgttcgacggtacacggaacccgacggcctacccggcccgtcggtcctaccgttcccg

SEQ ID NO: 439809 - DNA, 606 bp, Homo sapiens
  misc_feature: GZ8MTXP02ISYKL.4.27.C05.1.454.CMB.2.raw
  modified_base (281)..(281): a, c, t, g, unknown or other
  modified_base (320)..(320): a, c, t, g, unknown or other
  modified_base (385)..(385): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgttgtgtatcgaagtgagccaggccacgtcccctntttagcatgtatcggatagaagccgcctgacgggatccngacgccgtcttctcgtaggactacctaactcgtagggaaaccacgacgccctactctacgaccanctacggccggtaacctaacgtttagatgacgcctacttattcgtgtaccacgtacggtcggactagttcggactacgtcggcgtaacgttcggttacggggacggtaacgggaccgtaaacgggtccgtacggtaacccggtccggtacggggtaccaccggaacccgtaacgggtcccgttcccggaccccccgttcgggtaccctaccgtttcccccgg

SEQ ID NO: 439810 - DNA, 588 bp, Homo sapiens
  misc_feature: GZ8MTXP02HNGJX.4.27.C05.1.454.CMB.2.raw
  modified_base (261)..(261): a, c, t, g, unknown or other
  modified_base (266)..(266): a, c, t, g, unknown or other
  modified_base (281)..(281): a, c, t, g, unknown or other
  modified_base (286)..(286): a, c, t, g, unknown or other
  modified_base (293)..(293): a, c, t, g, unknown or other
  modified_base (332)..(332): a, c, t, g, unknown or other
  modified_base (358)..(358): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtcgtccccaggacagacacgccaaccattacctgcttcgtaggaaatgaattggcagtattaagttgtgtgtgtatnagtgngcagccagtcccctntttancatgtancggatagaagcggcctgaggactcctagcgccctcttcnctggactccatcgtaggaacacgacnccactctcgacatcgacgcggaaccctaagtttacgagtagacgaccgtacttattcgtgtaccacgtacggtacgggacgagtcgggactacggtcgtcgacgttcggtacggggaccgggacgggaaccgacggtaccgtacggtacccggtccggttacgggtaccgaccggtaacccggaacgtcccggtacccggtcccccggtacgtccgttaccttcccccgg

SEQ ID NO: 439811 - DNA, 643 bp, Homo sapiens
  misc_feature: GZ8MTXP02F57CJ.4.27.C05.1.454.CMB.2.raw
  modified_base (282)..(282): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtgtccccaggacagacagccaccattacctgctctaggaaatgaattggcagtataagtttgtgtgttggtatcaagtgaggccaggccagtcccctntttagcatgtatcggatagaagcgcctgagggactccgtgacgcccgtcttctctggactcccaactcgtagggaacacgacgcccactctgaccatcgacgaccgggaaccctaacgttttagacgttacggacggtcccgtacttactttcgtcgtacctacgacggttacgggaaccgtagttcggggacctacggtcgtacgtaacgttccgttccggggacgggtacggggtaaacccgaaacggccgttacgggtaacccggttcccggttacggggtacccgaaccggaacccccggaaacgggtcccgtacccggtacccccccgttccgggttacccgtaccgtttccccgg

SEQ ID NO: 439812 - DNA, 590 bp, Homo sapiens
  misc_feature: GZ8MTXP02JF2Y7.4.27.C05.1.454.CMB.2.raw
  modified_base (278)..(278): a, c, t, g, unknown or other
  modified_base (315)..(315): a, c, t, g, unknown or other
  modified_base (327)..(327): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttgatcaagtgagcaggccacgtcccctntttagcatgtatcggatagaagcgcctgaggctccgngagccgtcttcnctggactccaactcgtagggaacacgacgccactctcgaccatcacggaccggaaccctaacgtttacgagtcggacgccgtacttactttctgtacacgtacggtaggacgtagtacgggcacgtcggacgtacgttcgtcgggacgggtacgggaaccgacgtccgtacggtacccggtccggtacggggtcccgtaccgggaaccccgtaaacgggtcccgtcccggccccccgtttacgggtcccctaccgtttccccg

SEQ ID NO: 439813 - DNA, 689 bp, Homo sapiens
  misc_feature: GZ8MTXP02JIUTJ.4.27.C05.1.454.CMB.2.raw
  modified_base (214)..(214): a, c, t, g, unknown or other
  modified_base (281)..(281): a, c, t, g, unknown or other
  modified_base (384)..(384): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagtttgtgtgttggtatcaagtgaggccaggccagtcccctntttagcatgtatcggataggaagcggccctgagggactccgtgagcccgcttcctctggacttacccaactccgtaggggaaacacgtacgaccctacgttcncgacccataccgacggaccgggtaaccctaaacgttttacgacttaggacgggtccgaacgttattttaccgtcgtttaccaaccgtacggtacgggaacgtacgttacgggggacctaaccggttcggaccggttaacgttccgggtttaccggggacccgggggtaacggggtaacccgaaacggtcccgtacgggtaaccccggttaccccggtcgggggttacccgaccgggaaccccggaaacggtaccccggtacccggtacccccccgttcgggttcccctaaccccgtttcccccgg

SEQ ID NO: 439814 - DNA, 657 bp, Homo sapiens
  misc_feature: GZ8MTXP02GP2S5.4.27.C05.1.454.CMB.2.raw
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagttgtgtgtgtatcaagtgagcaggccagtcccctntttagctatgtatcggatagaagcgcctgaggatcccgtgacgcccgtcttctcgtacggactacccgaactcgtacgggaaacacgacgcccaactctacgaccataccgacggaccgggtaaccctaacgttttagacgttaggaacggtaccgtacttacgtttcgtacgttaccacgtacgggttacgggacgtacggtcgggacctaacggtcggacggtacgttccggttaccgggggaccgggtaacggggaacccgaaacggtcccggtacggtaaccccggttccggtacggggtacccgaaccggaaccccggtaacgggtcccgttaccccggaccccccgttcgggtacccctacccgtttcccccgg

SEQ ID NO: 439815 - DNA, 625 bp, Homo sapiens
  misc_feature: GZ8MTXP02G1KPX.4.27.C05.1.454.CMB.2.raw
  modified_base (214)..(214): a, c, t, g, unknown or other
  modified_base (286)..(286): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggacagtattaagtttgtgttgttggtatcaagtgaggccaggccagtccccttntttagctatgtatcgggatagaagccggccctgagggactcccgagagcccgtcttctcgtaggactccaactcgtacgggaactacgacgcctactcacgaccacgtacacggaccgggaaccctaaacgttttagacgtcgacgggacccgtacttactttcgtgttaccaacgtacgggtacgggtacaaggtcgggacctacgtcgacgtagttccggttaccgggcggtaacgggaccgaaaggtccgtacggtacccgttccggtacgggtccgaccggaacccgtaacggtcccgtaccggtcccccgtccgggtccctaccgtttccccgg

SEQ ID NO: 439816 - DNA, 618 bp, Homo sapiens
  misc_feature: GZ8MTXP02F7S7B.4.27.C05.1.454.CMB.2.raw
  modified_base (278)..(278): a, c, t, g, unknown or other
  modified_base (311)..(311): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagtataagttgtgtgttggtatcaagtgagcaggccagtcccctntttagctatgtatcggatagaagcgcctgaggntccgtagacgccgtcttcgtctaggactccaactccgtagggaacacgacgcctactctacgaccatcacgaccggtaccctaacgtttacgactacggacgtaccgtactactttacctagtaccacgtaacggtcgggtaaccagttagggcctaacgttcggacgtaacggtcgttaccggggacggtaacgggggaacccaaagggtccgtacggaccccggttaccggttcgggtacccgacggtaaccccgaacggcccgttcccggtccccccgttacggttcctaacccgttttccccg

SEQ ID NO: 439817 - DNA, 534 bp, Homo sapiens
  misc_feature: GZ8MTXP02IL26E.4.27.C05.1.454.CMB.2.raw
  modified_base (276)..(276): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccctgctctaggaaatgaattggcagataagttgtgtgttgatcaagtgagcaggccagtcccctntttancatgtatcggatacgaagcgcctcgaggctccgtgacgccgtcttctctggactccaactcgtacggaacacacgcctactctacgaccatcgacgcggacctaacgtttagactcgagtccgtacttatttcgtcgtcacgacgtggacacgtcggcacgtgcgagtccgtcggacggacggacacggcgtacggaccgtcgtcggtccgacgcccgaacggtccgtccgccccgtcggtcctaccgttccg

SEQ ID NO: 439818 - DNA, 561 bp, Homo sapiens
  misc_feature: GZ8MTXP02IQXOQ.4.27.C05.1.454.CMB.2.raw
  modified_base (276)..(276): a, c, t, g, unknown or other
  modified_base (326)..(326): a, c, t, g, unknown or other
  modified_base (437)..(437): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagttgtgtgtgtatcagtgagccaggccagtcccctntttagcatgtatcggatagaaagcgcctgaggactcctgagccgtcttcnctgactccaactcgtagggaacacagccactctcgaccatccaggaccgggtaaccctaacgttttacgagtagacgggtacctacttatttctggttaccacgttacggngggtaccagtacgggctacgtggcgtattcgtacgggacggaacggaccgaaaggctacggacccgtccgtcgggtaccacggaacccgaacggcctccggtcccccgtcggtcctacgtcccg

SEQ ID NO: 439819 - DNA, 584 bp, Homo sapiens
  misc_feature: GZ8MTXP02IZTZW.4.27.C05.1.454.CMB.2.raw
  modified_base (215)..(215): a, c, t, g, unknown or other
  modified_base (245)..(245): a, c, t, g, unknown or other
  modified_base (254)..(254): a, c, t, g, unknown or other
  modified_base (274)..(274): a, c, t, g, unknown or other
  modified_base (311)..(311): a, c, t, g, unknown or other
  modified_base (348)..(348): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaaccattaccngctctggaaatgaattggcagataagttgngtgtgtatnagtgagcaggcagtcccctntttgcatgtatcggatagaagcgcctgaggatcccgngacgccgctctctggactcccaactcgtgggaacacncgcccatctgaccatcacgccggaccctaagtttacgatagacggccctattactttcgtacgtccacgtacggtgggacctagtcgggacctacgtcggcgtaacgttcgttacggggacggtaacgggggaccctaaaggccgttacggaacccgttccgtacggggttaccgacgaaccccgaaacgggtccctcccggtaccccccgtcgggttaccctacccgtttcccgg

SEQ ID NO: 439820 - DNA, 716 bp, Homo sapiens
  misc_feature: GZ8MTXP02J2147.4.27.C05.1.454.CMB.2.raw
  modified_base (214)..(214): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagttgtgtgttgtatcaagtgaggccaggccagtcccctntttagcatgtatcggatagaagcgcctgagggactcccgtgacgccgtcttctcgtggactcccaactcgtaggggaaccacgacgcccaactccgtcgaacccactacgaacggacccggggtaaccctaaacgttttaggacttacggaacgggtacccttaacttattttaccgtcgttaccgaaccgtaccgggttaggggaacccgtaagttcgggggacctaacggtaccgggtcgtaacggtttccggttaccgggggacgggtaaaccgggggtaacccgaaaacgggtccccggttaaacggtacccccggggtttccgaacggggggtttcccccaaaaccggggtcccccgtaaaaccgggggccccgtacccggggttaccccccccggttaccggggttaccccttacccggtttaccccccg

SEQ ID NO: 439821 - DNA, 526 bp, Homo sapiens
  misc_feature: GZ8MTXP02FIDSM.4.27.C05.1.454.CMB.2.raw
  modified_base (280)..(280): a, c, t, g, unknown or other
  modified_base (337)..(337): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctnttttagcatgtatcggatagaaagcggccctcgagggactcccgtgagccgctttcnctggactcccaactctcggggaaacacagccactctgaccatcagcgggacccaactttacgatgacggccgactatttctgtcacacgtgggacagtgggcactgcgagtcgtcggcggaggaccagcgtcgaccgtccgtcgggtccacgaacccgaacggcctcgcccccgtcggtccacgtcccg

SEQ ID NO: 439822 - DNA, 641 bp, Homo sapiens
  misc_feature: GZ8MTXP02IJH3Y.4.27.C05.1.454.CMB.2.raw
  modified_base (282)..(282): a, c, t, g, unknown or other
  modified_base (313)..(313): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtcccaggacagacagccaccattacctgctctaggaaatgaattggcagtataagtttgtgttgttggtatacaagtgaggccaggccagtcccctntttagcatgtatggatagaacgcggccctanacgggatcccgtagacgccgtcttctctaggactacccaactcggtaggaaacacacgccctatctgaaccataccgagaccgggaaccctaaacgtttagacgttacgacgggaccctaaactcttttacgtacgttacaaccgtaaccggttgggaacgtaacgtcgggacacgttacggacgtacgttaccggttacggggacgggaaccgggtaccggaaacggacgttacggaacccggttccgtaacgggggttcaaccgggaacccgtaaacgggaccgtacccggtacccccgttccgggtacccgttaacttcccccgg

SEQ ID NO: 439823 - DNA, 531 bp, Homo sapiens
  misc_feature: GZ8MTXP02IP5EJ.4.27.C05.1.454.CMB.2.raw
  modified_base (280)..(280): a, c, t, g, unknown or other
  modified_base (419)..(419): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcggccctgagggactcccgtgagcccgcttctcgtaggactcccaactctagggaaactaccagccactctgaccatcacgcggaaccctaactttagatgacgccgactattctnttcactagtgggacagtcgggacacgtgcgtagtcgttacggcggacgggacccaagcctagaccgtcgtcgggtccacgcccgaagcctcgccccgtcggacctacgttcc

SEQ ID NO: 439824 - DNA, 538 bp, Homo sapiens
  misc_feature: GZ8MTXP02IOV9G.4.27.C05.1.454.CMB.2.raw
  modified_base (279)..(279): a, c, t, g, unknown or other
  modified_base (427)..(427): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccactctcactgtccgtgtccccaggacagacagccaccattacctgctctggaaatgaattggcagataagttgtgtgttggtatcaagtgaggccaggccagtcccctntttagtcatgtatcgggatagaaagcggcctcgagggactccgtgacgcgtcttctctggactccacgtcgtacgggaaacacacgccactctcgaccatcgacggccgggaaccctaacgtttagatcggacggccgacttatttcngtcacgacggtgggacagtcgggcacgtcgcgatcgttcggcggtaggaccaaggcctcggacccgtcgtcgggtcaacgcccgaacggcctccgccccgtcggtctaccg

SEQ ID NO: 439825 - DNA, 656 bp, Homo sapiens
  misc_feature: GZ8MTXP02JRR7D.4.27.C05.1.454.CMB.2.raw
  modified_base (213)..(213): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctaggaaatgaattggcagtattaagttgtgtgttggatcgaagtgagccagccagtcccctntttagctatgtatcggataggaagccgcctcgagggtactccgtggacgcccgtcttcgtcgtaggacctaccgaaacgtcgtaacgggaaacaccgacgcccaacttccgacgacctactaccgacggacccgggtaacccgttaaaccgttttagacgttacggaacggtacccgtacttacgtttacgtcgttacgacgtacggtacggacgtaagtcgggtacacgttacgcgtaacgttccgttacggggacgggtaacgggaaccgaacggccgtaccgggtaacccggttccggacgggtaccgaaccggtaaccccgaacgggtaccctacccggtaccccccgtccggtacccgtacccgtttccccg

SEQ ID NO: 439826 - DNA, 569 bp, Homo sapiens
  misc_feature: GZ8MTXP02IZAG1.4.27.C05.1.454.CMB.2.raw
  modified_base (277)..(277): a, c, t, g, unknown or other
  modified_base (364)..(364): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagtataagttgtgtgtgtatcaagtgagccaggccagtcccctntttagcatgtatcggatagaagcgcctgagggactccgtgacgccgcttctctaggactccaactcgtagggaaacacagccactcngaccatcagcgggaaccctaatttagatgacggtaccgacttattcgtgtccaacgtacggtagggacaagtcggggacacgttcggcgtacgttcggttacgggcgggtaacgggacccaaagggccttacggaacccgttccggtcggggtaccacggcccgaaggtcccgtccggacccccgtcggtacctaccgtttcccg

SEQ ID NO: 439827 - DNA, 557 bp, Homo sapiens
  misc_feature: GZ8MTXP02H1CI7.4.27.C05.1.454.CMB.2.raw
  modified_base (280)..(280): a, c, t, g, unknown or other
  modified_base (313)..(313): a, c, t, g, unknown or other
  modified_base (317)..(317): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacatacctgctctggaaatgaattggacagtattaagttgtgtgttggtatcaagtgaggccaggccagtcccctntttagtcatgtatcggatagaagcgcctgaggntccngagccgtcttctctggactccaactcgtagggaacacgacgccactctacgaccatcgacgccgggaccctaacgttttacgatgacggccgtacttattctgtccacgtacggtgggacagtcgggcacgtcgcgtagtcgtacgggacggtacgggaccgaaaggcgtcggaacccgtccggtcgggtacgacggcccgtaacggccgtccggcccccgtccggtcctaccgttcccg

SEQ ID NO: 439828 - DNA, 662 bp, Homo sapiens
  misc_feature: GZ8MTXP02HI05G.4.27.C05.1.454.CMB.2.raw
  modified_base (286)..(286): a, c, t, g, unknown or other
  modified_base (344)..(344): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgccaccctcactgtccgtcgtccccaggacagacagccaccattacctgctctaggaaatgaattggacagtattaagttgtgtgttggtatcaagtgagccaggccacgtccccttntttagctagtgagtcggaataggaaagccggcctgaggactccgtgacgccgtcttcncgtagactaccaacgtcgtacgggaaaccacgacgacctactcctcgacctacgtacaacggaccgggtaacccttaaagttttacgacgttacggaacggtacccgtaacttactttacgtacggtacctaaccggtacggtagggaccaaggttcgggacctaacgtcgtacgtacgttccggttacgggaccggggtaacgggaaacccgtaggaccgttacgggacccgtttccgggtacggggtaccgaccggaaccccggaacggtcccctacccgggtccccccgttcggtaaccctaccgtttcccccgg

SEQ ID NO: 439829 - DNA, 602 bp, Homo sapiens
  misc_feature: GZ8MTXP02G0Y86.4.27.C05.1.454.CMB.2.raw
  modified_base (213)..(213): a, c, t, g, unknown or other
  modified_base (253)..(253): a, c, t, g, unknown or other
  modified_base (275)..(275): a, c, t, g, unknown or other
  modified_base (315)..(315): a, c, t, g, unknown or other
  modified_base (328)..(328): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctaggaaatgaattggcagataagttgtgtgtgtatnaagtgagcaggccagtcccctntttagctatgtatcggatagaagcgcctgagggactcccngacgcccgcttcnctggactccaactcgtacgggaaccacgacgccctaactctacgacccatccgaacggcccgggtaaccctaaacgttttacgagtcggaacgggtaccgacttagtttcctaggttaccaacgtacgggttacgggactaggtacgggaccacgtcggacgtacgttccgttacgggcggggtaacgggaccgaaagccgtacggacccgtccgtcgggtaccgaccgtcccgaacggccgtcccgcccccgtcggtaccctaccgtttcccg

SEQ ID NO: 439830 - DNA, 638 bp, Homo sapiens
  misc_feature: GZ8MTXP02HZAA7.4.27.C05.1.454.CMB.2.raw
  modified_base (176)..(176): a, c, t, g, unknown or other
  modified_base (214)..(214): a, c, t, g, unknown or other
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccaccattaccngctctaggaaatgaattggcagtattaagttgtgtgtgatcaagtgagcaggccagtcccctntttagcatgtatcggatagaagcgcctgaggactcctgacgcccgtacttctcgtaggtactacccgaacttcgtagggaaacacgacgaccctaacgtctacgaccagtacgacgaccggaccctaacgttttacgaagttcggaacggaccgtacttagttccgtacgttaccgaccgtacggtacgggtacgtacgttcgggaccgtaacgtcgtacgtaacgttccggttaccgggacgggtacgggaacccgtacggtaccgtaccggtaacccggttccggtacggttaccgaccggaacccgtaacggtcccgtacccgtcccccgtaccggtcccgttaacccgtttccccgg

SEQ ID NO: 439831 - DNA, 554 bp, Homo sapiens
  misc_feature: GZ8MTXP02H3511.4.27.C05.1.454.CMB.2.raw
  modified_base (251)..(251): a, c, t, g, unknown or other
  modified_base (273)..(273): a, c, t, g, unknown or other
  modified_base (301)..(301): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagatagttgtgtgtgatnaagtgagcaggccagtcccctntttagcatgtatcggatagaagcgcctnaggatccgtgagccgctctctggactccaactcgtagggaaaccacgacgaccctactctacgaccatacgacgaccgggaccctaaacgtttttagaacttggaacggccgtacttatttaccttgtaccgacgtaccggtgggacagtcgggcacgtgcgtatccgtcgggacgggacggaccgaaggcgtacggacccgtccgtacgggtcacgcccgaaggccctcgcccccgtcggtccaccttcccg

SEQ ID NO: 439832 - DNA, 658 bp, Homo sapiens
  misc_feature: GZ8MTXP02J1NLK.4.27.C05.1.454.CMB.2.raw
  modified_base (213)..(213): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtcgtcccaggacagacagccacattaccngctctaggaatgaattggcagtatagttgtgtgttgtatcgagtgaggccaggccacgtccccttntttagcagtgtagtcggatagaacgcggcctagagggtactccgtgacgtccgtcttcgtcgtaggactacccgtaacgtcgtaggggaaaccacgacgtccctactcgtacgaccctagtaccgacggaccgggtaacccttaagttttacgagtacggtacggtaccgttacgttacgtttccgtgttaccgaacgtacgggtacgggaaccgtaggtacgggaccgtacgtcggacgtacgttccggttacggggacggtacggggaacccaaggtccgtacgggtacccgttccggtacgggtaccgaccggtaaccccgtaaacgggtcccgttcccggtaccccccggtcggttacccgtaccgtttccccgg

SEQ ID NO: 439833 - DNA, 657 bp, Homo sapiens
  misc_feature: GZ8MTXP02GFEK3.4.27.C05.1.454.CMB.2.raw
  modified_base (295)..(295): a, c, t, g, unknown or other
  modified_base (338)..(338): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtcgtccccaggacagacacgccaccattacctgctctaggaaatgaattggacagtattaagtttgtgttgttggtatcgaaggtcggaggccaggcctacgtccccttntttagctatgtagtcggatagaacgcgccctgagggactccgngagccccgtcttcgtctacggacttaccccgaaacgttccggaacgggaaaccaccgtacgccctaacttccacgacctacgtaccgacggacccgggtaacccttaacgtttacgacgttacggacggtaccgtacttactttcgtacgtaccgacgtacggtacggacgtagtcgggactacgtcggtacgtacgttcggttcgggacgggtaacgggaccgaacggtccgtacggtacccggttccgtacgggtaccgaccggaacccggtaacggtccgtacccggtcccccgtcggtaccctaccgtttccccg

SEQ ID NO: 439834 - DNA, 554 bp, Homo sapiens
  misc_feature: GZ8MTXP02HREGZ.4.27.C05.1.454.CMB.2.raw
  modified_base (213)..(213): a, c, t, g, unknown or other
  modified_base (245)..(245): a, c, t, g, unknown or other
  modified_base (275)..(275): a, c, t, g, unknown or other
  modified_base (280)..(280): a, c, t, g, unknown or other
  modified_base (356)..(356): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctctaggaaatgaattggcagtattagttgngtgtgatcaagtgagcaggccagtcccctntttanctatgtatcggatagaagcgacctgacggactccgtgacgtccgtcttctcgtggactaccaactcgtagggaacncgacgcctactctacgaccatcgagccggtacctaagtttagacgtgacgtacgtacttattctacgtactacgtacggtcggacgtagtcgggactacgtcgacgtacgtcggtcgggacggtacggaccgaagcgtacggtaccgtcgtacggcacgaaccgacggcctcccggccccgtcggtcctaccttcccg

SEQ ID NO: 439835 - DNA, 625 bp, Homo sapiens
  misc_feature: GZ8MTXP02JPI67.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagattaagttgtgtgttggtatcaagtgaggccaggccagtcccctnttttagctatgtatcggatagaaacgcggcctgacgggactcccgtgacgcccgtctttctcgtggactaccaactcgtaggggaaacacgacgccactctacgaccatcgacgccgggaccctaacgttttagactacggaacggcccgtacttacgtttctcgttaccaacgtacggtgggaacgtaaggttcgggacctacgtcggacggtaacgttccggttcggggacgggtacggggaacccgtaaacggccgttacggaacccggttccgtacgggggtccgacggaaccccgaagggtcccgtccggacccccgttcggtacctaccgtttcccgg

SEQ ID NO: 439836 - DNA, 694 bp, Homo sapiens
  misc_feature: GZ8MTXP02IAJEF.4.27.C05.1.454.CMB.2.raw
  modified_base (277)..(277): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctctaggaaatgaattggcagtatagttgtgtgtgtatcaagtgagccaggccagtccccttntttagtcatgtatcggataggaaacgcggcctgagggctacccgtgagccgtcttcgtctggactccgaacttcgtacgggaaacacgacgccgtactctacacccatacgacggaccgggtaaccctaacgtttttaacgacgttacgacgggtacccgtactttacgtttcgtacgttaccacgtacgggttacgggaacgtacggttacggggacctacggttacggcggttaacggtttcccggtttaccgggggaaccggggtaacgggggaaacccgtaaacgggtcccgttaccgggtaaaccccgggttaccgggttcgggggttacccaacgggtaacccccggaaacggtcccccgtaccgggtcccccccgtttacccggggttacccttaacccgtttcccccgg

SEQ ID NO: 439837 - DNA, 651 bp, Homo sapiens
  misc_feature: GZ8MTXP02J1EUF.4.27.C05.1.454.CMB.2.raw
  modified_base (152)..(152): a, c, t, g, unknown or other
  modified_base (212)..(212): a, c, t, g, unknown or other
  modified_base (249)..(249): a, c, t, g, unknown or other
  modified_base (272)..(272): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctntatgagctgactcagccaccctcactgtccgtgtccccaggacagacagccacattaccngctctaggaatgaatggcagtatagttgtgtgtgtancagtgagccaggccagtcccctntttacgctagtgtagtcggtaataggaacgcggaccctgagggactcccgtgacgtcccgtcttacgtcgtaggtactaccaacgttcggtacgggaaaccacgacgacccaacttcgacgacctagtcccgaacgggtacccgggtaacccttaaacgttttacggaacgtcgggtaacgggtacccgtacctttacgtttaccgtaccgttaccgaacgtacgggtacgggaacccgtaggttcgggacctaacgtcggacgtcgttaccgggttcgggacgggtaacgggacctaggccgtacggtaccggttccgacgggtaccaccggcccgaacggtcccgccggtcccccgtcggtacctacccgttccccg

SEQ ID NO: 439838 - DNA, 732 bp, Homo sapiens
  misc_feature: GZ8MTXP02HGAG1.4.27.C05.1.454.CMB.2.raw
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggacagatagttgtgtgttgtatcgagtgaggccaggcctacgtccccttntttagctagtgtagtcgggataaggaaacgccggccctaggacgggtactcccgtaggacgtccccgtcttccgtcgtaggactacccgaacgtcgtaacgggaacacgacgccctacgtcctacgaacctatacccgacgggtacccgggtaacccttaaacgttttacggacgtacggtaaccggtacccgttaacgtttaacgttttccgtacgttacccgtaacggtacgggttacggggaaccgtaaggttcggggacctaacggttcggtaccggtaacgtttccggggttaccgggggacccggggtaaacggggaaccccgaaaggtcccggttaccgggtacccggttacccgggtcggggttacccgaacccggaaccccggtaaacgggcccgttacccggtccccccgttccgggttaccctacccggtttccccgg

SEQ ID NO: 439839 - DNA, 658 bp, Homo sapiens
  misc_feature: GZ8MTXP02G2YIS.4.27.C05.1.454.CMB.2.raw
  modified_base (214)..(214): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaatggcagtataagtttgtgtgttggtatcaagtgagccaggccacgtcccctntttagctatgtagtcggatagaaacgcggccctgagggtactcccgtgacgccgtcttctcgtggtactcccaactcgtacgggaaacacacgcccactccgcgtaacccataccgacggacccgggtaacccttaaacgtttttacgacgttacggaacggtacccgtaactttactttcccgtaggttccgaaccgtacgggttacggggaaccgtaaggttccggggcctaacgtacggcggtaacgttccggttacgggggaccgggaacggggaacccgtaacgtcgtaacggtcccggtacccggtcggggtaccgaccggccccgaacgggtcccgtaccggcccccgtcgggtaccctaccgtttcccg

SEQ ID NO: 439840 - DNA, 563 bp, Homo sapiens
  misc_feature: GZ8MTXP02JU5CI.4.27.C05.1.454.CMB.2.raw
  modified_base (214)..(214): a, c, t, g, unknown or other
  modified_base (244)..(244): a, c, t, g, unknown or other
  modified_base (278)..(278): a, c, t, g, unknown or other
  modified_base (307)..(307): a, c, t, g, unknown or other
  modified_base (330)..(330): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagttgngtgtggtatcaagtgaggccaggccagtcccctntttagcatgtatcggatagaagcggcctnagggactccctgagccgtcttcncgtggactcccaactcgtacgggaaacacgagcccactctagaccatcacgaccgggaaccctaacgtttagactggacggccgtacttatttctgtcctacgacggttacggactaagtgggacacgttgccgtagtcgtcggggcgacggggaccaagcgtacgaccgtccgtacggggtccacggaaccccgaacgggtcctccggcccccgtcggtccacgtttccccg

SEQ ID NO: 439841 - DNA, 610 bp, Homo sapiens
  misc_feature: GZ8MTXP02HW27N.4.27.C05.1.454.CMB.2.raw
  modified_base (215)..(215): a, c, t, g, unknown or other
  modified_base (219)..(219): a, c, t, g, unknown or other
  modified_base (245)..(245): a, c, t, g, unknown or other
  modified_base (253)..(253): a, c, t, g, unknown or other
  modified_base (323)..(323): a, c, t, g, unknown or other
  modified_base (327)..(327): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctaaaagctcagccacctcactgtccgtgtccccaggacagacagccacattaccngctntaggaatgaattggcagattagttgngtgtgatnaagtgagcaggcctacgtccccttatttacgctatgtagcggaataggaacgcgcctagagggactccgngacncccgtctttctcgtagactaccgaacgtcgtaacgggaaacacgacgaccctactctacgaccatacgacggtaccggtaaccctaagttttagacgtacggacggacctacttacttacgtacgtacgtaacgtacgggtacgggaacgtaggtcgggtaccaacggtcggacgtacgttcggtacggggacggacgggaaccctagtccgtacggccgttccggacgggtaccacggaacccgacggtcccgtaccgccccgtcggtacctaccgttcccg

SEQ ID NO: 439842 - DNA, 652 bp, Homo sapiens
  misc_feature: GZ8MTXP02HRAOZ.4.27.C05.1.454.CMB.2.raw
  modified_base (216)..(216): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacagccaccattaccngctctggaaatgaattggcagtattaagttgtgtgttggtatcaagtgaggccaggccagtccccttntttagctatgtagtcggatagaaacgcggccctgagggactccgtgagcccgtcttctctggattcccgaacttcgtagggaaccacgacgcccactctacgacctagtccgaacggacccgggtaacccttaaacgttttacgacgttacggaacgggtacccgtaacttacgtttcgttcgtacctaccgtacggttacgggaactaggtcgggactacgttcggacgtacgttccggttcggggacgggacgggtaacccgaagtcccgtacgggacccggttaccggtacggggttacccaacggtaacccccgaaggtccccgtcccggtccccccgttccggtaccctacccgtttcccccg

SEQ ID NO: 439843 - DNA, 605 bp, Homo sapiens
  misc_feature: GZ8MTXP02IF6M9.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaatgaattggcagtataagtttgtgtgtgatcaagtgagccaggcctagtcccctnttttagctagtgtagtcgggataaggaaacgccggccctagagggtactcccgtgacgtcccgtcttcgtctcggactacccacgttcgtacgggaaacaccgagccctacgtcacgacctagtcacggccggtaaaccctaagttttagacgttgacggtacctattactttcgtagtaccacgtacgggtacgggactacgtcgggactacgtggacgtatcggttacgggacgaacgggaccaaggtctacggacccgtcggtacggtccgacggaacccgaacggtccgtcccggtcccccgtcggtaccacccgtttccccg

SEQ ID NO: 439844 - DNA, 644 bp, Homo sapiens
  misc_feature: GZ8MTXP02GE3UE.4.27.C05.1.454.CMB.2.raw
  modified_base (219)..(219): a, c, t, g, unknown or other
  modified_base (288)..(288): a, c, t, g, unknown or other
  modified_base (329)..(329): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtcccgtgtccccaggacagacagcccacctattaccngctctaggaaatgaattggcagtataagtttgtgtgttggtatacagtgaggccagcctagtccccttntttgctatgtagtcggataggaacgcgcctgaggactccgngacgcccgtcttctcgtggtactccaacgtcgtagggaacacgacgccactcacgaccagtaccgacgccgggtaaacccttaacgttttacgacgtacggaaccggtaccgtacgttactttaccgtacgtaccaacgtacgggtacgggtaaccgtaggttcgggaccgtacggttcggacggttacgtccggtttacggggacgggtaacggggaccgaaacggtccgtaccggtacccggtccgttccgggaccgaccgaacccggtacggtccgtacccggtcccccgtccggtcctacccgtttccccg

SEQ ID NO: 439845 - DNA, 520 bp, Homo sapiens
  misc_feature: GZ8MTXP02FIWQ5.4.27.C05.1.454.CMB.2.raw
  modified_base (279)..(279): a, c, t, g, unknown or other
  modified_base (312)..(312): a, c, t, g, unknown or other
  modified_base (333)..(333): a, c, t, g, unknown or other
  modified_base (413)..(413): a, c, t, g, unknown or other
  modified_base (497)..(497): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaacctcactgtccgtgtccccaggacagacagccaccattacctgctctggaaatgaattggcagataagttgtgtgttggtatcaagtgaggccaggccagtcccctntttagtcatgtatcgggatagaaagcggccctnagggactcctgagccgcttcnctggatccaactcctaggggaacacagccactctcgaccatcagccgggaccctaactttagatgaggccgactatttcngtcacacggtggacagtgggcacgtgcgatcgttcggcggacgggaccaaggctgacccgtcgtcgggtcacgcccgaaggccncggccccctcggtccaccgtccg

SEQ ID NO: 439846 - DNA, 523 bp, Homo sapiens
  misc_feature: GZ8MTXP02GGYA9.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttggtatcaagtgagccaggccagtcccctntttagcatgtatcggatagaaagcggcctgagggactcccgtgacgccgtcttctctggactccaactcgtagggaaacacgacgcccactctagaccatcgacgacgggaccctaactttagatgacggccgacttatttctgtcacgacgtgggacagtcggcacgtgcgatcgtcggcggacggaccagcgtcgaccgtcgtcggtcacgccgaggcctcgccccgtcggtctacttccg

SEQ ID NO: 439847 - DNA, 544 bp, Homo sapiens
  misc_feature: GZ8MTXP02FF6M5.4.27.C05.1.454.CMB.2.raw
  modified_base (256)..(256): a, c, t, g, unknown or other
  modified_base (282)..(282): a, c, t, g, unknown or other
  modified_base (338)..(338): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagtataagtttgtgtgttggtancaaagtgaggccaggccagtcccctntttagcatgtatcgggatagaaagcggccctcgagggactccctgagcccgcttcnctggactccaactctagggaaacacacgccctactctgacccatccgaaggcccgggtaccctaaacgttttacgattcggacggtccgacttatttcctagtcacgacggtgggacagtcggacactgcgatcgttcgggacggacgggaccagctcgaccgtccgtggtcacgcccgaagccgcgcccccgtcgccgacttccg

SEQ ID NO: 439848 - DNA, 560 bp, Homo sapiens
  misc_feature: GZ8MTXP02J1R1N.4.27.C05.1.454.CMB.2.raw
  modified_base (214)..(214): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagttgtgtgtgtatcaagtgagccaggccagtcccctntttagcatgtatcggataaggaacgcggccctgagggactcccgtgacgcccgtcttcgtcgtggactcccgaactcgtacgggaaacacgagcccactcgtacgaccatcgacggaccggtaaccctaacgtttagatcggacgtaccgtacttactttctcgtcacgtacgtgggactagtcggcacgtcgcgagtcgtacggacggacggacgacgcgtacgaccgtcgtcggtacacgcccgaacggccgtccggtcccccgtcggtccacgttcccg

SEQ ID NO: 439849 - DNA, 625 bp, Homo sapiens
  misc_feature: GZ8MTXP02HC0UH.4.27.C05.1.454.CMB.2.raw
  modified_base (351)..(351): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtcgtccccaggacagacacgccaccattacctgctcgtaggaaatgaattggacagtataagtttgagtgttggatcgaaggtgaggccaggcctacgtcccctttatttagcatgtagtcgggtaataggaaacgcccggtcctacgacgggtactcccgtggacncccggtcttcgtactcggacttacccgaacgtcggtacgggaaacctaccgacgaccctacgtccgtaacgaccctacgtaccggaccggtacccgggtaacccttaaacgtttacgaacgtacggaacggtacctacgttactttcgtacgtacgacgtacggtcggacaggtcgactacgtcgcgtagtcgtacgggcggaacggaccagcgtacgccgtccggtcggacacgccgacgtcctcccggtcccgtacggtcctaccgttcccg

SEQ ID NO: 439850 - DNA, 609 bp, Homo sapiens
  misc_feature: GZ8MTXP02JB9CZ.4.27.C05.1.454.CMB.2.raw
  modified_base (215)..(215): a, c, t, g, unknown or other
  modified_base (291)..(291): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccactattaccngctcgtaggaaatgaattggacagtattaagtttgtgttgttagtatcgaagtgacgccaggcctacgtccccttntttagctatgtagtcggataggaacgccgacctagacgggctcccgtgacgtccgtcttcgtctacggactaccgaagtcgtagggaaccacgacgtccacttcacgaccacgtacgacggaccggtaaccttaacgtttagagtacggacgtaccgtatttactttcgagtaccgaacgtacggttaggactagtcgggacctacggtacgacgtacgttcggtcggggaacggacgggacctaggtccgtacggacccgtcggtacgggacaccggaaccgacggtcctcccggcccctcggtacctcgtttcccg

SEQ ID NO: 439851 - DNA, 660 bp, Homo sapiens
  misc_feature: GZ8MTXP02JRT7L.4.27.C05.1.454.CMB.2.raw
  modified_base (153)..(153): a, c, t, g, unknown or other
  modified_base (216)..(216): a, c, t, g, unknown or other
  modified_base (279)..(279): a, c, t, g, unknown or other
  modified_base (284)..(284): a, c, t, g, unknown or other
  modified_base (327)..(327): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccttnttatgagctgactcacgccaccctcactgtccgtgtccctaggacagacagccactattaccngctagtaggaatgaattggacagtatagttgtgtgtgatgagtgagcaggcctagtccccttntttanctatgtagtacggataaggaacgccggcctaggaggactccgngtacgcccgttcttcgtcgtaggtactacctaaccgtcgtacgggaaacctaccgacgaccacttccacgaccactaccggaacgtacccgggtaaacccttaacgtttagacgttacgggaaccggtacctaactttacttttacgccgttaacgaccggtaaccggggttgggaacccgaagggtacgggtactaacggtggtacccggttattccgggtaccggggacgggtaaccgggacgaacgtcgtaacggtacccggtcgtacggggacaaccggtaacccgacggtcccgcccggttcccctcggtaccctacggtttcccccg

SEQ ID NO: 439852 - DNA, 634 bp, Homo sapiens
  misc_feature: GZ8MTXP02I0LU5.4.27.C05.1.454.CMB.2.raw
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccacattacctgctctaggaatgaattggcagataagttgtgtgttgtatcagtgaggccaggcctacgtccccttntttagctatgtagtcggataaggaaagccggccctgagggactcccgtgacgccgtcttcgtcgtggactaccctaacgtcgtacgggaaaccaccgacgacccgaactctacgaccacgtaccgacggtaccgggtaaacccttaacgttttagacgttacggaacggtacccgttacttacgtttacgtacgttaccgacgtacggtacgggtacgacgttcgggactacgtcggcgtaagttccgttacggggacggaacgggtaaccacggccgtacggacccgttcggtacggttaccgaacgtcccgaacggcccgtccggtcccccgtacgtccgtaccgtttcccg

SEQ ID NO: 439853 - DNA, 608 bp, Homo sapiens
  misc_feature: GZ8MTXP02HZL6D.4.27.C05.1.454.CMB.2.raw
  modified_base (287)..(287): a, c, t, g, unknown or other
tcagagcactgtagcacgaccggtgctcgatttagacgcgatcgaagggtttggggctgggcctcaggaagcagcatcggaggtgcctcagccatggcatggatcccctctcttcctcggcgtccttgcttactgcacaggatgcgtgacctcttatgagctgactcagccaccctcactgtccgtcgtccccaggacagacagcccaaccattacctgctctaggaaatgaattggcagtattaagtttgtgtgttggtatcaagtgaggccaggccagtcccctntttagcatgtatcggatagaagcgccctgaggactcccgtgacgccgtcttccgtctagggactcccaactcgtacggggaaaccaccgacgcccactctacgaccatcacgccggtaccctaacgttttacgagtagacggccgtacttactttcgtacgttaccacgtacggtagggacgtagtcgggcacgtcgcgtacgttcgttccgggacgggaacgggaccgaaacggtcgtacggtacccgtccggtcgggtccgaccggaacccgaacgggtccgtcccgtcccccgtaccggtccgtacccgtttccccgg

SEQ ID NO: 439854 - DNA, 613 bp, Homo sapiens
  misc_feature: GZ8MTXP02G625O.4.27.C05.1.454.CMB.2.raw
  modified_base (277)..(277): a, c, t, g, unknown or other
  modified_base (321)..(321): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgtgtatcaagtgagcaggccagtcccctntttagcatgtatcggatagaaagcgccctgaggactccctgacnccgtcttctctggactccaacgtccgtagggaaacacacgccactctcgaccactacgacggtaccgggaaccctaaacgttttagacgttaggaccgggtaccgtacgtttaactttcgtacgtacctacgtacggtagggaacctaaggtccgggccaacgttcggacgtacgttaccgtcggggaccggggtaacggaacccgaagtcccgttacggaccccggtccgtacggggtaccaccggcccgaaacggccgtacccgcccccgtcggtaccctaccgttcccg

SEQ ID NO: 439855 - DNA, 627 bp, Homo sapiens
  misc_feature: GZ8MTXP02JTNCZ.4.27.C05.1.454.CMB.2.raw
  modified_base (214)..(214): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagttgtgtgtggtatcaagtgaggccaggccagtcccctntttagcatgtatcgggatagaaagcggcctcgagggactcccgtgacgccgtcttctctaggactccgaactcgtaggggaaacacacgccactctgaccatcacggaccgggtaccctaacgttttagacgttcggacgggtcccgtaacttactttaccgtcgttaccgtaaccgtacggtacggggaacctacggtacggggacctacgtacggtacgtaacgttccgttccgggggacgggaacgggggaacccaaacggccgtacgggtaacccggtcccgtacggggtccacggaaccccgaacggtcccgtaccgcccccgtccgggtcccaccgtttccg

SEQ ID NO: 439856 - DNA, 664 bp, Homo sapiens
  misc_feature: GZ8MTXP02FOXGF.4.27.C05.1.454.CMB.2.raw
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtccgtcgtccccaggacagacacgccaccattacctgctacgtaggaaatgaattggcagtataagtttgtgttgttggtatcgaagtgaggccacggcctacgttcccccttattttacgctagttgtagtcggataacggaaacggccggccctgagggtactcccgtaggacgtcccgtcctttcgtcgtacggtactacccgaacgttccggtacggggaaaccacgaaccgccctaactccgtacgaccacgtaccgacggacccgggtaaacccttaaagttttagagttacgggacggtaccgtaacttactttcgtcgtaccgtacgtagggtacgggaactaggtcgggctacgttgcgttagtccggttacggggacggtacggaccaacggtcgtaccggccgttccggcgggtaccacggtaaccccgaggtcccgtcccggtcccccgtcggtaccctacgtttccccg

SEQ ID NO: 439857 - DNA, 615 bp, Homo sapiens
  misc_feature: GZ8MTXP02H8TXA.4.27.C05.1.454.CMB.2.raw
  modified_base (214)..(214): a, c, t, g, unknown or other
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagtataagtttgtgtgtgtatcaagtgagcaggccagtcccctntttagcatgtatcggatagaagccgcctcgaggactccgtgacgtcccgtcttctctggactccaactcgtagggaacacgacgcccactctacgacctatccgacggaccgggtaaccctaacgttttacgacgttacggacggtacccgtacttacgtttcctcggtaccgacgtacgggttacgggacagtcggggactacgtcggacgtacgttccggttacgggacgggaacggaccgaacggtccggtacgtaccccggtccggtacgggtaccgaccggaacccgtaacggcccgtcccggacccccgtcggtaccctaccgtttccccg

SEQ ID NO: 439858 - DNA, 573 bp, Homo sapiens
  misc_feature: GZ8MTXP02JAW60.4.27.C05.1.454.CMB.2.raw
  modified_base (247)..(247): a, c, t, g, unknown or other
  modified_base (280)..(280): a, c, t, g, unknown or other
  modified_base (294)..(294): a, c, t, g, unknown or other
tcagagcactgtagcacgaccggtgctcgatttagacgcgatcgaagggtttggggctgggcctcaggaagcagcatcggaggtgcctcagccatggcatggatcccctctcttcctcggcgtccttgcttactgcacaggatgcgtgacctcttatgagctgactcagcccacctcactgtccgtgtccccaggacagacagccaccattacctgctctggaaatgaattggcagtataagtttgngtgtgtatcaagtgaggccaggccagtcccctnttttagctatgtancggatagaacgcgcctcgagggactccctgacgtcccgcttcgtctggactcccaacgtcgtacgggaacacacgcctatctgacctagacacgacgggacccttaagtttagacgtgacggtccgacttacttcgtaggtccacgtacggtacgggacgtagtcgggacacgttgacgtctacggttcgggaccggacgggaccaggccgtcggacccgtcgtcggtccgaccggaacccgaaggcccgttccggcccccgttcggacctcgttcccg

SEQ ID NO: 439859 - DNA, 597 bp, Homo sapiens
  misc_feature: GZ8MTXP02HOUIN.4.27.C05.1.454.CMB.2.raw
  modified_base (251)..(251): a, c, t, g, unknown or other
  modified_base (270)..(270): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtcccgtgtccccaggacagacagccaccattacctgctctggaatgaattggcagtatagttgtgtgtgatnagtgagcagccagtccctntttagctatgtatcggataaggaacgccggcctgaggactccgtgacgccctcttactcgtaggtactaccaacttcggtacggaaacaccgaccgccctactacgtacgacctacgcgacggaccggtaacccttaacgtttagacgttacggacgtccgtacttacgtttacgtagtactacgtacggtgggtaacctaggtcgggtacacgtggcgtacttcggtacgggacgggtaccgggaccgaagtcctacggtcccgtcgtaccgggtcaccggaacccgaggtccgtacccggccccgtcggtaccctaccgttcccg

SEQ ID NO: 439860 - DNA, 624 bp, Homo sapiens
  misc_feature: GZ8MTXP02HMOLF.4.27.C05.1.454.CMB.2.raw
  modified_base (176)..(176): a, c, t, g, unknown or other
  modified_base (214)..(214): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccaccattaccngctctaggaaatgaattggcagattaagttgtgtgttggtatcaagtgagccaggccagtcccctntttagcagtgtagtcgggataggaaacgccggaccctagagggactcccgtggacgccgtccttctcgtggactcccgaactcgtagggaacacgacgccactctacgaccatcgagccgggaacccttaagtttagctaggacggccgtacttgtttacgtcgtaccgacgtacgggtggaccgtaagtcgggactacgttcggacgtagttccggttacggggaccgggacgggaacccgtaaggccgttacggaacccggttcgtacgggggttacccacgggaaccccgtaagggtcccgtaccggtaccccccgtacgggtaccctacccgtttcccgg

SEQ ID NO: 439861 - DNA, 724 bp, Homo sapiens
  misc_feature: GZ8MTXP02JCDVK.4.27.C05.1.454.CMB.2.raw
  modified_base (259)..(259): a, c, t, g, unknown or other
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgttccttgcttactgcacaggatgcgtgacctcttatgagctgactcagccaccctcactgtccgtgtccccaggacagacagccacctattacctgctactaggaaatgaattggacagtataagttgtgtgttgatnagtgagccaggccagtcccctntttagctatgtagtcgggataggaaacgccgggcctacgaacgggctcccgtaggacgtccccgtcgttacctcgttacggacttacccgaaacttcgggtacgggaaacctccgaacgccctaacgtccgtacgaccctagtaccacgggtaccggtaaccccttaaagtttacggattacggacgggtacccgtacgttactttaccgtcggttaccgaacgtaacgggttcggggaaccctaggtaccggggctaaccggtgtaccgtaacgtttcgggtaccgggggaccgggtaaacggggtaaccccgaagggcccttaaaccggggtaccccggtttacccggggttcgggggtaccctaaccgggtaacccccgaacgggggtccctacccgggtccccccggtttaacgggtaccccttacccggttttccccg

SEQ ID NO: 439862 - DNA, 604 bp, Homo sapiens
  misc_feature: GZ8MTXP02JFFMW.4.27.C05.1.454.CMB.2.raw
  modified_base (253)..(253): a, c, t, g, unknown or other
  modified_base (255)..(255): a, c, t, g, unknown or other
  modified_base (285)..(285): a, c, t, g, unknown or other
  modified_base (483)..(483): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattacctgctcgtaggaaatgaattggacagtattagttgtgtgtgntnagtgagcaggcctacgtccccttagtttanctatgtagtggaatagaacgcggccctagagggctccgtgacgccgtcttccgtcgtacggactacctaacgtcggtacgggaaacacgacgcctactcgacgtaccagtaccggacggtacccggtaacccttaagtttagacgtaggtaaccggtcctaacttactttacgcgttaccacgtacgggtacggaacnggtacgggctacgtgacgttagtccggtacgggacggaacggaccgacggccgtacggacccggtcgtacggtaccaccgaaccgtcgccgtaccccgcccgttcggtacctccgttcccg

SEQ ID NO: 439863 - DNA, 658 bp, Homo sapiens
  misc_feature: GZ8MTXP02F60QN.4.27.C05.1.454.CMB.2.raw
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagcccaccattacctgctctaggaaatgaattggcagtataagttgtgtgtgtatcgaagtgagccaggcctagtcccctgtttagcatgtagtcggataggaaacgccggcctgaggtactcccgtgacgtccgtcttactcgtacggtactacccgaacttccgagggaaaccacgacgccctaactctacgaaccactaccgacggaccgggtaaccctaaacgttttacgacgtacggaacggtccgtaaccttagtttccgtacgtaccgtaaccgtacgtacgggtactaaggttcgggaccgtacgtacggtacggtacgttaccggttacgggacgggtaacgggacccgaaacggtccggtacggtacccggttaccggtcgggtaccgaaccggtaacccgtaaacgggtccgtacccggtcccccggtcgtacccgtacgttccccg

SEQ ID NO: 439864 - DNA, 575 bp, Homo sapiens
  misc_feature: GZ8MTXP02HTFZK.4.27.C05.1.454.CMB.2.raw
  modified_base (214)..(214): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctggaaatgaattggcagataagttgtgtgttggtatcaagtgaggccaggccagtcccctntttagcatgtatcggatagaaagcggccctcagggatcccgtgacgcccgtctttcctctggatcccaaacttccgtaggggaaacaccgacgacccactactcgaacccatccagaccgggaaccctaacttttacgatgaggccgtactacttctgttcacgtacgtgggacgagtgggcacgtgcgagtcgttcgggcggacgggaaccgtaaagcgtacggacccgtccgtcgggtaccacggtccccgaaaggcccgttccggcccccgttcggtaccctacgtttcccgg

SEQ ID NO: 439865 - DNA, 586 bp, Homo sapiens
  misc_feature: GZ8MTXP02G5WS8.4.27.C05.1.454.CMB.2.raw
  modified_base (289)..(289): a, c, t, g, unknown or other
  modified_base (321)..(321): a, c, t, g, unknown or other
  modified_base (326)..(326): a, c, t, g, unknown or other
  modified_base (339)..(339): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacagccaccattacctgctcgtaggaaatgaattggacagtattaagtttgtgtgttggtatcgaagtgaggccaggcctagtcccctntttagcatgtatcggatagaagcgcctgaggntccgngacgccgtcttcncgtgactccaactcgtagggaacacgacgccctactcacgaaccagtaccgacggaccggaaccctaaacgtttagacgttcgacggaccgtagtactttcgtcgtacaccgtacggtcgggactacgtcgggcacgtgacgtacgttccggtacgggcggtaacgggacccaaggcgtacggaccgttccgtacgggtccacggcccgtaacggccgtaccgcccccgttcggcctaccgttcccg

SEQ ID NO: 439866 - DNA, 614 bp, Homo sapiens
  misc_feature: GZ8MTXP02FPG3Q.4.27.C05.1.454.CMB.2.raw
  modified_base (297)..(297): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacacgcccaccattaccctgcttctaggaaatgtaattggacagtattaagtttgtgttgttggtatcaaggtgaggccaggcctacgtcccccttnttttagcagtgtagtcggataggaaacgccgccgtagacggactcccgtagacgcccgtcttctgtcggactccgaactcgtacgggaaaccacgacgcccactcgtacgaccctataccgacgaccggtaaccctaaacgtttagacgttacggaacggtccgtactatttcgtacgtacgtaacgtacggtagggaccaaggtcggacctagtcgacgtacgtcgtcgggacggacggaccgaaggcgtacgtaccgtccgtcggaccgacgaacccgacgtccgtaccgtccccgtacgtccgtacctttcccg

SEQ ID NO: 439867 - DNA, 632 bp, Homo sapiens
  misc_feature: GZ8MTXP02G911A.4.27.C05.1.454.CMB.2.raw
  modified_base (281)..(281): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtattaagttgtgtgttgatcgagtgagccaggcctagtccccttntttagctatgtatcggataggaacgccgcctgagggctcccgaggacgcccgtcttctcgtaggactaccgaactcggtagggaaaccacgacgcccaactctacgaccagtaccgaacggtacccgggtaaacccttaaacgttttagacgtacggtaacgggtacccgtaactttacgtttaccgtacgttaccgaacgtacgggttacgggacgtaggtcgggactaacgtcggacgtacgttccggttacgggacgggtaacggaccgtaaggccgtacggaccggttcgtacggggtaccacggaacccgacggtccgtcccgccccgtcggtacctacgttcccg

SEQ ID NO: 439868 - DNA, 665 bp, Homo sapiens
  misc_feature: GZ8MTXP02IU6L0.4.27.C05.1.454.CMB.2.raw
  modified_base (282)..(282): a, c, t, g, unknown or other
  modified_base (326)..(326): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtcgtccccaggacagacagccaccattacctgctctaggaaatgaattggcagtattaagttgtgtgttggtatcaagtgagccaggccagtcccctntttagcatgtagtcggaatagaaagccgcctgagggtactccgngacgccgtcttctctggactcccaactcgtagggaaacctacgacgaccctacgtcgttacgaaccacgtaccgaacgggtaaccggggtaaacccctttaaaaccgtttttaaggacgtttacgggaaccgggtacccttaaacgttacgttttaccgtacggtttacccaaaccggttaggggttaccggggaactaacgggttcggggacctacggttacggacgtacttccggttacggggacgggtaacgggaccgtaacgccgtaacggccgttcgtacgggtccgaacgcccgaacggccgttcccggccccgtcggttaccgactttcccg

SEQ ID NO: 439869 - DNA, 636 bp, Homo sapiens
  misc_feature: GZ8MTXP02JW3UL.4.27.C05.1.454.CMB.2.raw
  modified_base (281)..(281): a, c, t, g, unknown or other
  modified_base (286)..(286): a, c, t, g, unknown or other
  modified_base (325)..(325): a, c, t, g, unknown or other
  modified_base (369)..(369): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactcgtccgtgtccccaggacagacagccacattacctgctctaggaaatgaattggacagtataagtttgtgtgttgtatcagtgagcaggcctagtccccttntttancatgtagtcggatagaagccggccctagagggactccgngagcccgtacttctcgtggactccaactcgtacgggaactacgngaccctactacgtcgaacctagtaccgacggtacccgggaacccttaaacgtttttacgacgtcggaacgggtacccgtactttacgtttacgtcgttaccacgtaacgggtgggtaccgtagtacgggaccagttcggacgtacgttcgttacggggcgggtaacgggaacccgaggtaccgtaccggtaccgtccggtcgggtacccaccggaacccgtaacggtcccgtcccggtcccccgttcggtacccgtaccgttccccg

SEQ ID NO: 439870 - DNA, 538 bp, Homo sapiens
  misc_feature: GZ8MTXP02FJ8WQ.4.27.C05.1.454.CMB.2.raw
  modified_base (281)..(281): a, c, t, g, unknown or other
  modified_base (528)..(528): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagataagtttgtgtgttggtatcaagtgaggccaggccagtcccctnttttagcatgtatcggatagaaagcggccctgagggatcccgtgagccgcttctctggatcccaactcgtagggaaacacacgccactctgaccatcgagcgggaccctaacgtttagatgacgccgtactatttcgtgtcacgacgtgggacagtcgggcacgtgcgatcgttcggcggacggaccaagccgtcgaccgtccgtacgggtcgacgaaccccgaaggccgtcgcccccgtcggtccnccgttccccg

SEQ ID NO: 439871 - DNA, 604 bp, Homo sapiens
  misc_feature: GZ8MTXP02HUDBI.4.27.C05.1.454.CMB.2.raw
  modified_base (247)..(247): a, c, t, g, unknown or other
  modified_base (278)..(278): a, c, t, g, unknown or other
  modified_base (335)..(335): a, c, t, g, unknown or other
  modified_base (362)..(362): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccaccattacctgctctaggaaatgaattggcagattaagttgngtgttgatcaagtgagcaggccagtcccctntttagctatgtatcggataggaacgcggcctgagggactccgtgacgtccgctttcncgtggactccaactcgtacgggaaacncgacgcccactctacgacctatcgacgccggtaaccctaacgttttacgagtacgacggaccgtacttactttacgtcgtcctacgtacggttacggaacgtagtcgggactacgtgaccgtacgttccggtacgggacgggtaacgggaaccgtaaggccgtacggaccgttccggtcgggtaccaccggaacccgacggcccgttcccggacccccgttcggtacccttaccgttccccg

SEQ ID NO: 439872 - DNA, 584 bp, Homo sapiens
  misc_feature: GZ8MTXP02FGXQD.4.27.C05.1.454.CMB.2.raw
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctcgtaggaaatgaattggcagtataagtttgtgtgttggtatcaagtgaggccaggccagtcccctntttagcatgtatggatagaaagcggcctgaggactcctgacgccgtcttcgtctggactcccaacttcgacgggaaacacgacgccctactctacgacccatcgacggaccggaaccctaaacgttttagacgttacggacgggtaccgtacgttacttttctcgtaccacgtacggtagggaccagtcggactacgttcgcgtagtcgttcgggcgggaacgggacccgaaggtcgtacggaccgtccgtcggggtccacggccgaacggcccgtccgcccccgtcggcctaccttccg

SEQ ID NO: 439873 - DNA, 727 bp, Homo sapiens
  misc_feature: GZ8MTXP02HUK1Q.4.27.C05.1.454.CMB.2.raw
  modified_base (216)..(216): a, c, t, g, unknown or other
  modified_base (255)..(255): a, c, t, g, unknown or other
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtcgtccccaggacagacagccaccattaccngctctaggaaatgaatggcagattagttgtgtgtgtatnaagtgagcaggcctagtccccttntttagctagttgtagtacgggtaataacggaaacggtccggtaccctcggaacgggactcccgtagacgtccccgtcttacgtcgtacggtacttacccgtaacgtccgttagggaaacctacgaccgtaccctacgttcgtacgacctacgtacccgtacgttacccgggtaaaccctttaaacgttttacggacgttacggacggtaccgttactttactttcgttacgttactacgtacgggtacgggacgtacgtcgggaccgtacgtacggtacggttacgttaccgggttacgggggacggggtaaccggggaaaccggtaacggtacccggtaccgggtacccgggttcccggtaccggggttaccgaacccggtcccggtaaaccggtcccggttccccggtcccccggttccggttacccttacccggttttcccccgg

SEQ ID NO: 439874 - DNA, 707 bp, Homo sapiens
  misc_feature: GZ8MTXP02JKNT2.4.27.C05.1.454.CMB.2.raw
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggcagtataagttgtgtgttgatcgaagtgagccaggcctacgtccccttntttagctatgtatcggataggaagccggccctgacgggactcccgtggacgtccgtacttccgtcgtaggacctacccgtaaacgtcggtacggggaaaacctacgaccgtaccctaacttccgtaccggaaaccctagtacccgaacgggacccggggtaaaccctttaaaccgtttttaacgagtacggtaaccgggtacccgtaactttaacgttttccgtacgtacctaaccggtacgggtaacgggacctaaggtcggggaccaacgttcggtccgtacgttccggtaccggggaccgggaaacgggacccgaacggtccgtacccgggtacccgtcccgggttacggtaccgaaccgaaccccggtaacggtccccgttccccggacccccgtttccggtaccctacccgtttccccg

SEQ ID NO: 439875 - DNA, 554 bp, Homo sapiens
  misc_feature: GZ8MTXP02HVQG4.4.27.C05.1.454.CMB.2.raw
  modified_base (213)..(213): a, c, t, g, unknown or other
  modified_base (272)..(272): a, c, t, g, unknown or other
  modified_base (319)..(319): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccacattaccngctctggaatgaatggcagataagttgtgtgtgtatcaagtgagcaggccagtcccctntttagcatgtatcgggaataggaacgcggccctgagggactccccgnggacgccgtctttctcgtggactcccaatcgtagggaaacacacgccactcacgaccatcgacgccgggaccctaacgttttacgagttgacggtcccgtacttactttactgtcaacgtacggtgggactagtcgggcacgtgcgatcgtcggcggtacggacaagcgtcggtaccgtccgtcgggtccacgcccgaaggccgtcccggtcccccgtcggtccctacgttcccg

SEQ ID NO: 439876 - DNA, 627 bp, Homo sapiens
  misc_feature: GZ8MTXP02GHXMT.4.27.C05.1.454.CMB.2.raw
  modified_base (278)..(278): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattacctgctctaggaaatgaattggacagtatagttgtgtgtgtatcaagtgagcaggcctacgtccccttntttagctatgtagtcggataggaacgccgcctgagggtactccgtgacgcccgtcttctcgtacggactaccaacgtcgtacgggaaacacgacgaccctactctacaccagtaccgacggacccggtaacccttaaacgttttagacgttacggacggtaccgtacgttactttcgtcgtaccacgtacggtacgggaacgtaggtcggactacgtgacgtacgtccggttacggggaccgggtaacgggaccgaacggtccgtacggtacccggttccggtacgggtaccgaccggaacccgaacggtcccgtcccggtcccccgtacggtacctaccgtttccccg

SEQ ID NO: 439877 - DNA, 632 bp, Homo sapiens
  misc_feature: GZ8MTXP02GFSHW.4.27.C05.1.454.CMB.2.raw
  modified_base (279)..(279): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggacagataagttgtgtgtgtatcaagtgagccaggccagtcccctntttagctatgtatcggatagaagccggacctgagggactccgtgacgcccgtacttctcgtaggactacccgactcgtcgggaaaccacgaccgccctaactctacgaccctactaccgaacggacccgggtaaacccttaaacgttttaacgacgttacggaaccggtaccctaacgttactttaccgttacggtaccctaaccgtacggttacggggacctaagtcgggaccacgttcggacgtacgtcggtacggacggggaacggaccgaagtccgacggtacccgtccggtacggcgaacgccccgaaacggccgtaccgcccccgttacggtccctaccgtccccgg

SEQ ID NO: 439878 - DNA, 767 bp, Homo sapiens
  misc_feature: GZ8MTXP02IIAQ0.4.27.C05.1.454.CMB.2.raw
  modified_base (213)..(213): a, c, t, g, unknown or other
  modified_base (254)..(254): a, c, t, g, unknown or other
  modified_base (277)..(277): a, c, t, g, unknown or other
tcagagcactgtagcacgaccggtgctcgatttagacgcgatcgaagggtttgggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaatgaattggcagattaagttgtgttgtgtatnaagtgagccagccacgtcccctntttagctatgtagtacggataaggaaacgcggccctcgagggtactcccgtggacgtcccgtacttctcgtagactacccaacttccggtacgggaaacaaccgacgccccctaacgttcctacggaaccctagtacccgaacgggtacccggggtaaacccttaaacgtttttacgacgttacggaacggtaccgtaaccttattttaccgtcgttaccgaacgttaccgggtagggtaaccgtaaggttcggggacctaacgttcgggtaccgttaaacgtttcccgggtttaccgggggaaccgggggtaaaccggggtaaaacccgaaacgggttccccggttaacggggtaaaccccccggtttccggggttaccgggggttaccccgaaaccgggtaacccccgttaaaaccgggggaccccttaccccgggtacccccccggtttccggggttacccctttaaccccgggttttttccccccg

SEQ ID NO: 439879 - DNA, 657 bp, Homo sapiens
  misc_feature: GZ8MTXP02F5VF1.4.27.C05.1.454.CMB.2.raw
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgccaccctcactgtccgtgtccccaggacagacacgccaccattacctgctcgtaggaaatgaatggcagtataagttgtgtgttgtatcaagtgagccaggcctacgtcccctnttttagctagtgtagtcggataggaacgccggccctgaggtactccgtagacgccgtccttcgtcgtacggtactacccaacgttcgtacgggaaaccacgacgccctaactctacgaaccactaccgaacggtacccggtaaacccttaaacgttttacgacgttacggtaacgggtacccgtaaactttacgtttacgtacgtaccgtaaaccgtacgggtacgggtaaccgtagtacggggactaccgtggtacgtacgtcggttacggggacgggaacggaccgaaggtccgtacggtacccggttccgtacgggtaccgacggaacccgaacggtccgtcccggcccccgtcggtcctaccgtttcccg

SEQ ID NO: 439880 - DNA, 623 bp, Homo sapiens
  misc_feature: GZ8MTXP02IHPJO.4.27.C05.1.454.CMB.2.raw
  modified_base (292)..(292): a, c, t, g, unknown or other
  modified_base (360)..(360): a, c, t, g, unknown or other
  modified_base (481)..(481): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtgtccccaggacagacacgccacattacctgctcgtaggaaatgaattggacagtattaagttgtgttgtgtatacgaagtgacgccaggcctacgttcccctttntttagctaattgtagtacggaataaggaaacgccggaccctagaagggactccgtgacgcccgtcttntcgtggactccaacgttcgacgggaaacacgaccgccactctacgaccacgtacgacgacccggtaacctaacgtttagacttaggaccggtcctattacgttactcgtacgacgtacggngggactagtcgggacacgtcgacgacttcggtacgggacggacgggaccaacggcgtaccggtaccggttccgacgggtaccaccggaacccgtaaacgtcccgtacccggtcccccgttacggtcccttaccgtcccccgg

SEQ ID NO: 439881 - DNA, 645 bp, Homo sapiens
  misc_feature: GZ8MTXP02FINCL.4.27.C05.1.454.CMB.2.raw
  modified_base (282)..(282): a, c, t, g, unknown or other
  modified_base (340)..(340): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagtttgtgtgttggtatcaagtgagccaggccacgtcccctntttagcatgtatcggataggaaacgcgccctgagggtactccgtgacgcccgtcttcncgtggactccaacgtcgagggaacacgacgccctactctacgaccagtaccgacggaccggtaacccttaaacgtttacgacgtacggacggccttaacgttactttcgtcgtacctaacggtacggtacgggtacgtaggtcggggacctacggtcggtacgtacgttccgggttaccgggggacgggtaaacgggaaccgtacgtaccggtaccggtaacccgggttccggtacgggaccgtaaccggaacccggaacggtcccgtccccggtcccccggttacggtcccaccgtttccccgg

SEQ ID NO: 439882 - DNA, 699 bp, Homo sapiens
  misc_feature: GZ8MTXP02JQ8V6.4.27.C05.1.454.CMB.2.raw
  modified_base (291)..(291): a, c, t, g, unknown or other
  modified_base (585)..(585): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccaccattacctgctctaggaaatgaattggcagattaagttgtgtgttggtatcgaagtggaggccgaggcctacgttccccctttnttttacgctagttggtagtcggggaataacggaaacggtcccggtccctagacggggacttacccccgtggacgccccggtctttccgtcgtacggaacttcccgaaacgttccggtacggggaaaccaccgacgtaccctacgtcctacggaccctaacgtccgaaccgggtacccgggtaaaccccttaaagtttacgacgtacggtacggtacctacgtttaagtttccgtaggtacctaccggtaaggggtcggtaacgtaggttacggggcctaacgttcggaaccgtntttcccggggtacgggccgggtaaacgggaccaacgggtcgttaccgggcccgttccggtcggtaccgacgaacccgaggtcccgtcccgccccgtcggtaccctcgtttcccg

SEQ ID NO: 439883 - DNA, 692 bp, Homo sapiens
  misc_feature: GZ8MTXP02GNPBW.4.27.C05.1.454.CMB.2.raw
  modified_base (286)..(286): a, c, t, g, unknown or other
  modified_base (291)..(291): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccttcttatgagctgactcagcccacctcactgtccgtgtccccaggacagacacgcccactattacctgctcgtaggaaatgaattggcagtattagttgtgttgttggtatgaagtgacgcaggccagtccccttntttanctatgtagtcggatagaacgcgcctgtaggactccgtagacgtccgtccttctcgtacggactacccgtaacttcggacgggaaactaccgacgaccctacgtcgtacgacctagtaccacggacccgggtaacccttaaagtttacgacgtcggaaccgtccgtaacgttacgtttcgtaccgttactaaccggtcggtagggaacctggttaccggggactaacggttcgtaccggtacgttccgggttacggggaaccggggtaacgggaaccccgttaaggcccgttaccgggtaacccggtttcccgggacggggttaacccgaccgggtaaccccgaacgggtcccgttacccccggtacccccggttcgggtacccctaccgttttcccccggg

SEQ ID NO: 439884 - DNA, 680 bp, Homo sapiens
  misc_feature: GZ8MTXP02H5870.4.27.C05.1.454.CMB.2.raw
  modified_base (252)..(252): a, c, t, g, unknown or other
  modified_base (275)..(275): a, c, t, g, unknown or other
  modified_base (316)..(316): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagatagttgtgtgttgatnaagtgagccaggccagtcccctntttagctatgtatcggatagaagcgcctcgaggactcccgngacgccgtcttctcgtggactccgaaacgtcgtacggggaaacaccgtacgccctaactcctacgacccactaccgacggaccgggtaaaccctaaacgtttttaacgacgtacggaacggacccggtacttacttttacgttcgttaccgtaccgtagttagggtacggggtaccgtacggttacggggaccgtaccgtacggtaccggtacgtttccggttaccggggtaccggggaacgggtaacccgaaacggtcccggtacggtaaccccggttacccggtcggggttaccgaaccggacccccgtaaacgggtccccgttacccggtcccccccggttacggttaccccgttcccccg

SEQ ID NO: 439885 - DNA, 625 bp, Homo sapiens
  misc_feature: GZ8MTXP02IGAUI.4.27.C05.1.454.CMB.2.raw
  modified_base (212)..(212): a, c, t, g, unknown or other
  modified_base (277)..(277): a, c, t, g, unknown or other
  modified_base (315)..(315): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccacattaccngctctaggaaatgaattggcagtataagttgtgtgtggtatcaagtgagccaggccagtcccctntttagcatgatcggatagaagcgcctgaggactcccgnggacgcccgtcttcgtcgtcggactaccgaactcgtacgggaaacacgacgccctaactctacgaaccactccgacggaccgggtaaccctaaacgttttacgacgttacggacggtaccgtacttacgtttccgtcgtacgacgtacgtacgggactagtcgggacacgtcgacgtagttaccggttacgggaccggtacggggaaccctaacggccgtacgggtaaccccgttccggtcggggtaccaccggaacccgaacggggtccctcccggaccccccgttcggtaccctaacccggttccccg

SEQ ID NO: 439886 - DNA, 557 bp, Homo sapiens
  misc_feature: GZ8MTXP02F6A51.4.27.C05.1.454.CMB.2.raw
  modified_base (286)..(286): a, c, t, g, unknown or other
  modified_base (322)..(322): a, c, t, g, unknown or other
  modified_base (335)..(335): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggacagtattaagtttgtgttgttggtatacaagtgaggccaggccagtcccctntttagcatgtatcggatagaagcgcctgaggctccngacgccgtcttcnctggactccaacttcgtgggaaacacacgccactctagaccatccagaccggacctaagtttacgagtgacggtcccgtaattagtttctgtaccacgtaggtacgggaccaggtcgggctacgtggacgtagtaccgttcggggacggaacggaccaaggcgtacgaccgtccgtcggtccacgaaccgacggtctacccgccccgtcggtacctactccg

SEQ ID NO: 439887 - DNA, 527 bp, Homo sapiens
  misc_feature: GZ8MTXP02FF5HD.4.27.C05.1.454.CMB.2.raw
  modified_base (280)..(280): a, c, t, g, unknown or other
  modified_base (330)..(330): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctntttagcatgtatcggatagaaagcgcctgagggactcctgagccgcttcntggatccaactcgtgggaacacgagccactctgaccatcagcggacccaatttagatgagcgactattctgtcacacgtgggacagtcgggcactggcgactcgttcggcggtacggggacaacggctacggtaccgtccgttacggtccacggaacccgaacggccgtcgcccccgttacggcccacggtttcccg

SEQ ID NO: 439888 - DNA, 692 bp, Homo sapiens
  misc_feature: GZ8MTXP02JKTSM.4.27.C05.1.454.CMB.2.raw
  modified_base (220)..(220): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagacacgcccaccattaccngctctaggaaatgaatggacagtattagttgtgtgttggtatcgaagtgacgccgaggcctacgtcccccttagttttagctagtgtagtacggataggaaacgtccggacctgacgggtactcccgtagacgccgtcttctcgtaggtactaccgacgttcggtaacgggaacaccgtacgccctaacttaccgacgtaacccgatacccgaacgggacccgggttaacccttaaagttttaacgacgttacggtaccggtaccgtaaccgttaacgttttccgacgttaccgtaaccggtaaccggggtacgggtaaccgtaggttacgggccctaacggtcgtacgacgttccggtacggggaccggaaacggggtaccaacgtaccggtacggtacccggtccgtacgggtccaaccggtcccggaacgtcccgtccggacccccgttcggtacctaccgtttccccg

SEQ ID NO: 439889 - DNA, 663 bp, Homo sapiens
  misc_feature: GZ8MTXP02FWC9B.4.27.C05.1.454.CMB.2.raw
  modified_base (214)..(214): a, c, t, g, unknown or other
  modified_base (283)..(283): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagataagtttgtgtgttggtatcaagtgaggccaggccacgtccccttntttagcatgtagtcggatagaaagcgccctgagggatcctgacgccgtcttctctaggactcctaactcgtagggaaaccacgacgccctaactctcgaaaccctacgtaccgacggaccgggtaaccctaaacgttttacgaacgttacggaacggtaccgtaacttaacgtttcgtacgttaccgacgtaacgggtcgggtaaccgtagtacggggacctacgtcggtacgtaacgttaccggttcggggacgggtacggggaaacccgaaaggtccgtaaacggacccggttacccggttcggggtacccgacccgggaacccgaaaccggggtcctaccccgggtcccccgttaccggtacccaccgttttccccg

SEQ ID NO: 439890 - DNA, 595 bp, Homo sapiens
  misc_feature: GZ8MTXP02JR7L9.4.27.C05.1.454.CMB.2.raw
  modified_base (153)..(153): a, c, t, g, unknown or other
  modified_base (177)..(177): a, c, t, g, unknown or other
  modified_base (217)..(217): a, c, t, g, unknown or other
  modified_base (263)..(263): a, c, t, g, unknown or other
  modified_base (277)..(277): a, c, t, g, unknown or other
  modified_base (287)..(287): a, c, t, g, unknown or other
  modified_base (319)..(319): a, c, t, g, unknown or other
  modified_base (322)..(322): a, c, t, g, unknown or other
  modified_base (358)..(358): a, c, t, g, unknown or other
tcagagcactgtagcacgaccggtgctcgatttagacgcgatcgaagggtttggggctgggcctcaggaagcagcatcggaggtgcctcagccatggcatggatcccctctcttcctcggcgtccttgcttactgcacaggatgcgtgacctnttatgagctgactcagccaccctnactgtccgtgtccccaggacagacacgccacctattaccngctctaggaaatgaattggcagtattaggttgtgtgtgatcagtgngcagcacgtccttntttagcagtntagtcggatagacgccgcctgaggtactccgngcncgtctctcgtcgactcccaacgtcgtaacggaaacnccgacgtaccactctacaccgtagtaccggacggtaccggtaccttaagttgacgtacggaacgtcttacttacttcgcgtacgacggtacggacggacaggtccggctacggtcgacgtacgttccgggacgggacgggaccgtacgacggtccgtacggtcccggtccgtacggaccgaccggtaacccggtacggtcccgtaccccgtccccggttcgtcccgttccgtcccgg

SEQ ID NO: 439891 - DNA, 685 bp, Homo sapiens
  misc_feature: GZ8MTXP02F4HOD.4.27.C05.1.454.CMB.2.raw
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacacgacacgcccacctattacctgctacgtaggaaatgtaattggacagtattaggtttgtgtgttgtatcgaagtgacgccacggcctacgttccccttatttacgctagtgtacgtacggatacggaacgcccggtaccctaggaacgggtacctccgtggacgtcccgttcctttacgcgtacggacctaccgtaacgttcggtacgggaaaccacgacccgtaccctactaccgtacgaacccacgtaccggaccgggacccggttaaacccttaacgttttaggacgttacgggaccggtaccgttactttacgtttaccgtacggtaccgtaccgggtacgggttacggacgtaggtacgggctacggtcgtacgtacgttccggtacggggacggacggtaccgacgcggtaccgccgttcggacggccaccggccgtacggtcccgaccccggtcccgtcggtcctacccgtttcccg

SEQ ID NO: 439892 - DNA, 729 bp, Homo sapiens
  misc_feature: GZ8MTXP02II0BU.4.27.C05.1.454.CMB.2.raw
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctctatgagctgactcacgccaccctcactgtcccgtgtccccaggacagacacgccacctattacctgctcgtaggaatgaattggactaagtattaggtttgtgttgttggtatcgaaggtgacggccaggccctacgttcccccttgttttagctagttgtagtacggtataaggaacgccggccctgacgggtactcccgagacgcccgtccttctcgtaggtactacccgaactcggtacggaacaccgaccgaccctacttccgacgaaacccgtactaccggtaaccgggacccgggtaaaccccgtttaaacgttttaaacggacggttacgggtaaaccgggttacccgttaaacgtttacgttttaccgtcgtaacccgtaacgggtaccggttacggggaaccgtaggtcggaccgtacgtggtccgtacgtccgggttacggggccggggtaaacgggacccagggtccgtaccggtaccccggttcggaccggggacctaccgggaaccccgtaacgggtccccgtaccccggtaccccggtaccggttaccctacccggtttcccg

SEQ ID NO: 439893 - DNA, 629 bp, Homo sapiens
  misc_feature: GZ8MTXP02HEOR0.4.27.C05.1.454.CMB.2.raw
  modified_base (152)..(152): a, c, t, g, unknown or other
  modified_base (363)..(363): a, c, t, g, unknown or other
  modified_base (410)..(410): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcacgcccaccctcactcgtccgtcgtcccaggacagacacgccaacctacttacctgctacgtaggaaatgtaagttggactaagtagttaaggtttgtgttagttggtatacgaaggtcggacggccgacggtaccctacgttccccttgtttacgctagtgtacgtggaataggacgccgcctagacggactccgngtcgccgtccttcgtctacggtactacctaacgtcggacggtaaacncgacgaccctacgtctacgacacgtaccgacggacccggtaaaccttaagttgacgtcggtacgaccgttattcgtttacgcgttacacggtacggtgaacctggtcgactcggtgcggtacgtcggacgggacggtaacggacaggtccgacggtccgtcgggacgtccgacggaacccgagggtcccctcgggtcccctacggtcaccccgtttccg

SEQ ID NO: 439894 - DNA, 625 bp, Homo sapiens
  misc_feature: GZ8MTXP02HGT6A.4.27.C05.1.454.CMB.2.raw
  modified_base (215)..(215): a, c, t, g, unknown or other
  modified_base (255)..(255): a, c, t, g, unknown or other
  modified_base (273)..(273): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtcgtccccaggacagacagccaccattaccngctctaggaaatgaattggcagtattagttgtgtgtgatnagtgagcagccatccctntttagcatgatcggaatagaacgcgcctagacggactccgtgacgcccgtcttcgtcgtagacttacccaagttcgtacgggaaacaccgaccgccctacgtctacgaaccactaccgacggacccgggtaacccttaaacgttttagacgtacggacggtaccgtacttacgtttcgtacgttaccaacggtacggtcgggaacgtaggtcgggacctacgtcggtacgtacgttccgggttacgggacgggaacgggtaacccgaacggtccgtacgggtacccgtccggtcgggtaccgaccgaacccgacggtccgtcccgtacccccgtcggtacctccgttccccg

SEQ ID NO: 439895 - DNA, 705 bp, Homo sapiens
  misc_feature: GZ8MTXP02HLDP3.4.27.C05.1.454.CMB.2.raw
  modified_base (176)..(176): a, c, t, g, unknown or other
  modified_base (214)..(214): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctnactgtccgtgtccccaggacagacagccaccattaccngctctaggaaatgaattggcagtattaagtttgtgtgttggtatcgaagtgacggccaggccagtccccttgttttacgtcatgtagtcgggataggaaacgccggtaccctgacgggactcccgtgacgtccgtcttacgtcgtaggtactacccgaactccggtacggggaaaccacgacgtaccctaacgtcctacgaaccctagtacccgaacgggtacccggggtaaaccctttaaacgttttacgacgttacggaaccgggtacccggttaacttacgtttttaccgtacgttaccaaaccgttacggggttacggggaactaacgggttcgggacctacggtacggtccgtacgttaccggttcgggggaaccgggtacgggaacccgaaggtccgtacggtacccggttccggtacgggtaccacggtaaccccggaacggcccgttacccggtcccccgtcggtaccctaccggtttccccg

SEQ ID NO: 439896 - DNA, 635 bp, Homo sapiens
  misc_feature: GZ8MTXP02I8HO6.4.27.C05.1.454.CMB.2.raw
  modified_base (284)..(284): a, c, t, g, unknown or other
  modified_base (343)..(343): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacacgccaccattacctgctctaggaaatgaattggcagtattaagttgtgtgttggtatcgaagtgaggccaggccagtcccctntttagctagtgtagtcggatagaagccgcctgagggactcccgtgacgcccgtctttcncgtaggactaccgaaacgttccgtaagggaaaccaccgacgcccctaacttcgtacgaaccctacgtccgaacggacccgggtaacccttaaacgttttacgacgttacggacggtaccgtacttactttccgtacgttaccaacgtacggtacgggtaaccgagtacgggcctacgtgacgtagttccgtacgggacgggtacgggaccgaaagccgtacgacccggttccgtacggtaccgacggaacccgaacggccgtacccggccccgtacggtcctacgtttcccg

SEQ ID NO: 439897 - DNA, 656 bp, Homo sapiens
  misc_feature: GZ8MTXP02I4DPJ.4.27.C05.1.454.CMB.2.raw
  modified_base (249)..(249): a, c, t, g, unknown or other
  modified_base (280)..(280): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactgtccgtcgtccccaggacagacagccaccattacctgctcgtaggaaatgaattggcagatagtttgngtgttgatcaagtgagcaggcacgtcccctntttagctatgtatcggatagaagcggccctgacggactcccgtagacgccgtcttctctggactccaactcgtagggaactacgacgcctacgtactcgaccatcgacggccgggaacccttaaagtttagacgtaggaaccggtcccgtaatttactttcgtacggttaccgtaacgtaccgggttacgggaaccgtaggtaccggggttaccaacggtttcggaaccggttacgttccgggttacggggacccgggtaacggggaacccgtaaacggtccgtacgggtacccgttccggttaacggggtaccaccggtaaccccgaaggttccccgtcccggaccccccgttcggtaccctaccgtttcccccg

SEQ ID NO: 439898 - DNA, 595 bp, Homo sapiens
  misc_feature: GZ8MTXP02HRJC5.4.27.C05.1.454.CMB.2.raw
  modified_base (156)..(156): a, c, t, g, unknown or other
  modified_base (279)..(279): a, c, t, g, unknown or other
  modified_base (284)..(284): a, c, t, g, unknown or other
  modified_base (377)..(377): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttangagctgactcacgccaccctcactgtccgtgtccccaggacagacagccacattactgctgtaggaaatgaattggacagtataagttgtgtgtgtatcaagtgagccaggccacgtcccttntttancatgtatcggataggaacgccggcctcgaagggcctcccgtagacgtccccgtcttcgtcgtacggtactccccaaagtccggtaggaaaccnccgacgcctactcacgacataccgacggtaccgtaaccttaagttagacgtacgacgtactacgttcgttcgtcgtaccgacgtacggtacgacgacgtcggacgtacgtcgtacggtcgtacggtacgggacgggacggacgacggccgtacggtacccgtcggtaccggtaccgacggtaaccgacggacccgtcccgcccgtcgtccgtacctcg

SEQ ID NO: 439899 - DNA, 647 bp, Homo sapiens
  misc_feature: GZ8MTXP02GY5MZ.4.27.C05.1.454.CMB.2.raw
  modified_base (215)..(215): a, c, t, g, unknown or other
  modified_base (355)..(355): a, c, t, g, unknown or other
  modified_base (569)..(569): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtgtccccaggacagacacgccaccattaccngctacgtaggaaatgaattggctagtattaagtttgtgttgttaggtatcgaagtcgacggccacggtcctacgttccccttagtttagctatggtagtacggaataacggaaacggccgtaccctagacggactcccgngtacgccgtcttcgtcgtacgacttaccgaactcggtacgggaaacaccgacgcctaacgtctacgacctacgtaccgaacggtacccgggaacccttaagtttacgacgttacggaacgtaccgtaactttcgttcgtcgtacctacggtacggttaccggataggcggtacctagtcgcgttacgtaccgggtacggacgggacggaaccgnggacgttacggacccgttcggtacgtcaccgtaacccgaggtcccgtcccggcccgttcggtacctaccgtttccccg

SEQ ID NO: 439900 - DNA, 668 bp, Homo sapiens
  misc_feature: GZ8MTXP02JATWO.4.27.C05.1.454.CMB.2.raw
  modified_base (214)..(214): a, c, t, g, unknown or other
  modified_base (275)..(275): a, c, t, g, unknown or other
  modified_base (315)..(315): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattaccngctctaggaaatgaattggcagatagttgtgtgttgatcaagtgagcaggccagtcccctntttagcatgtatcggatagaacgcgcctcgaggatcccgngacgccgtcttcgtcgtaggtactacccaacgtcgtagggaaaccacgacgcccactctacgacctactaccgacgtaccggggtaacccctaacgttttacgacgttacggtaacgggtacccgtaacgtttaacttttccgttacggttacctaaccggtacgggtacgggtaaccgtaggtacgggccgtacgtcggtaccgtagttccggttcgggggaccggggaacggggtacccgtaaacggtccggtaccggtaacccggtccggttacggggtaccgtaccgggtaaccccgaacgggtcccgtacccgggtcccccgtaccgggtaccctcccgtttccccgg

SEQ ID NO: 439901 - DNA, 688 bp, Homo sapiens
  misc_feature: GZ8MTXP02FU44A.4.27.C05.1.454.CMB.2.raw
  modified_base (293)..(293): a, c, t, g, unknown or other
  modified_base (298)..(298): a, c, t, g, unknown or other
  modified_base (407)..(407): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacacgcccacctattaccctgctcgtaggaaatgaattggacagtattaagtttgtgtgttaggtatcgaagtgagccaggcctcgttcccctntttanctatgtagtcggataaggaacgccgcctacgaggtactccgtgacgtcccgtcttcgcgtggtaactcccgtaaactcgtacgggaaacaccgacgtaccctacgttcncgaaaccctgaccgaacgggacccggtaacccttaaagttttacgacgttacggacggtaccttaacttacgtttccgacgttaccgaacgtacggtacgggacgtaggtcggctacgtcgtaacgtcgttaccggtacggggaccgggaacggtaaccgtaaacggtccgttaccgggtaccccggttccggtacgggggtacccaacggaacccccggtaaacggtccccggttccccggtaccccccgttacggttacccctacccgttttcccccgg

SEQ ID NO: 439902 - DNA, 625 bp, Homo sapiens
  misc_feature: GZ8MTXP02IOH22.4.27.C05.1.454.CMB.2.raw
  modified_base (248)..(248): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaaattggcagattaagtttgngttgtggtatcaagtgaggccaggccacgtcccctntttagcatgtatcggatagaagcggcctgaggactccgtgacgccgtcttctcgtgactccactcgtgggaacacgacgccactctcgaccatccgaggaccggtaacccttaaacgttttagacgttacggaacggtccgtaacttacgttttaccgttcggtttccgaacggttaccggtacgggggtacaacggttcggggacctaccgttggaccgtagttccggttacggggccggggaacgggaaccgaaaggtcctacggtacccggtttcgtcggggtccaccggaacccgaacggtcccgtcccgtcccccgtcggtaccctactttccccg

SEQ ID NO: 439903 - DNA, 731 bp, Homo sapiens
  misc_feature: GZ8MTXP02I4W0K.4.27.C05.1.454.CMB.2.raw
  modified_base (285)..(285): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtgtccccaggacagacagccaccattacctgctctaggaaatgaattggacaagtattaagtttgtgtgttgtatcaagtgagccaggccacgtcccctntttagcatgtatcggatagaagccgcctgaggtactcccgtggacgcccgtcttacgtcgtaggactaccgaacgtcgtacgggaacacgtacgccactctacgacctagtaccgaacgacccgggtaacccttaaacgttttacggacgtacgggtacggtacccgtaacgtttactttaccgtacggttaacccgacggttaccgggtaccggggtaaccgttaacggttacccgggggacccttaaccgggttaccggtaccggttaccgttacccggggtttacccgggggaaccggggttaaaccgggggaaccccgtaaacgggtccggttaacccggtacccgggttacccggtaccggggtaacccgtaccggtaaccccggtaacgggtccgtaccccgggtaccccccgttcgggtaccccttaccgtttcccccg

SEQ ID NO: 439904 - DNA, 580 bp, Homo sapiens
  misc_feature: GZ8MTXP02GGHY6.4.27.C05.1.454.CMB.2.raw
  modified_base (213)..(213): a, c, t, g, unknown or other
  modified_base (280)..(280): a, c, t, g, unknown or other
  modified_base (285)..(285): a, c, t, g, unknown or other
  modified_base (572)..(572): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacagccaccattaccngctcgtaggaaatgaattggacaggtataagttgtgtgtggtatcaagtgagccaggccagtccctntttancatgtatcggatagaagtcgctcgaggtactcctggacgcctcgttctcgtaggactccgtaaatcgtacgggaaacacgacgcccaacttcgacgaacccatccaacgaccgggtaaccctaaacttttaggaacttcggtaacgggacctacttatttaccgtgttaacacgtacgtacgggaacctagtacgggctaacgtgcgtagtcgtcggcggaacggaccgaagccgttagaccgtccgtacggtcgaacgcccgaaggcctcggtcccctcggtaccncgttcccg

SEQ ID NO: 439905 - DNA, 702 bp, Homo sapiens
  misc_feature: GZ8MTXP02F5V9Q.4.27.C05.1.454.CMB.2.raw
  modified_base (287)..(287): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacacgccaccattacctgctcgtaggaaatgaattggacagtataagttgtgttgtgtatcgaagtgacggccaggcctacgtccccttntttagctatgtagtcggataggaacgccgcctagaggtacctccgtggacgtcccgtacttccgtacgtacggtactacccgtaacgttcggtacgggaaaacccacgtaaccgtaccctaacgttaccgtaccgtaaacccgtaacgttacccggaaccgggtacccgggttaaaccccgtttaaacgtttttaaacggacgtttaacgggaaccggtacccgttaaacgtttacgttttacgtacggttaccgtaacggtacgggtacgggtacgtacgtacgggactacgtcgtacgtacgtcgggtacgggacggaacggtaccgacgtccgtacggtaccgtccgtcgggaccgtacggaaccgaacggtcccgtacccggtaccccgttacggtacctacgtttcccgg

SEQ ID NO: 439906 - DNA, 637 bp, Homo sapiens
  misc_feature: GZ8MTXP02IUM1H.4.27.C05.1.454.CMB.2.raw
  modified_base (218)..(218): a, c, t, g, unknown or other
  modified_base (338)..(338): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtccgtcgtccccaggacagacacgccacctattaccngctactaggaaatgaattggacagtattaagttgtgttgtgtatcaagtgacgcacggctacgtccccttagtttagctatgtagtcggataggaacgccggtcctacgagggactccgnggacgtcccgtcttcgtcgtgactaccacgtccgtagggaaaccacaccgtcctactcgtacgacctacgtacacggtaccggtaacccttaaagtttacgagttacggacgtacctacgttatttcgtacgtacgacgttacggaggtacgtacgtcgggctacggtcgacgtacgtacggttcggggaacgggaccggaacgtaacggtccgtacggtacccgttcggtaacgggcctaaccggaacccgaacggtcccgtacccggccccgttacggtacccttacgtttcccccg

SEQ ID NO: 439907 - DNA, 673 bp, Homo sapiens
  misc_feature: GZ8MTXP02FEQSP.4.27.C05.1.454.CMB.2.raw
  modified_base (281)..(281): a, c, t, g, unknown or other
  modified_base (319)..(319): a, c, t, g, unknown or other
  modified_base (333)..(333): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctaggaaatgaattggcagtataagtttgtgtgttggtatcaagtgagccaggccagtcccctnttttagcatgtatcggatagaaagcgccctgagggacncctgagccgcttcnctggactcccaaacttcgagggaaaccacgacgccctaactcctagaacccataccgaacggaccgggtaaccctaaacgtttttaacgacgttaggaacgggtaccgtaaacctttaacgttttacctcggttacctaccgacgggttacgggaaccgtaagtccgggggacctaccgttacggaccgtaagttccgtttacggggacgggtaacggggaacccgaaaacggtccgtacggtaacccggttccggttacggggtaccgaacggaacccccgaaaacgggtcccgtacccggtcccccccgttacggggtaaccctacccgtttcccccg

SEQ ID NO: 439908 - DNA, 658 bp, Homo sapiens
  misc_feature: GZ8MTXP02G8SA7.4.27.C05.1.454.CMB.2.raw
  modified_base (152)..(152): a, c, t, g, unknown or other
  modified_base (217)..(217): a, c, t, g, unknown or other
  modified_base (275)..(275): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagccaccctcactgtccgtcgtccccaggacagacacgaccaccattaccngctcgtaggaaatgaattggacagtattaagttgtgtgttggtatgaagtgacggccnggcctagtcccctttgtttacgctagtgttaagtacgggaataaggaaaacggccggtaccccgtaggaacgggtacctcccgtaggacgtcccgttactttcgtacgtaggtacctaccgtaaacgtcggtaacgggaaactaccgacgtccctaacgtcttacgaaccctagtccgtacggacccgggtaaccttaaacgttttagacgtacggacggtaccgtacttactttacgtcgtacgaccgtacggtggtacaggtcggactacggagcgtacgtacgtcgggacggacgggtacgacgtccgtacggtaccgtaccggttcggaccgtacgcccgaacggtccgtccggtccccctcggtacccaccgttcccg

SEQ ID NO: 439909 - DNA, 668 bp, Homo sapiens
  misc_feature: GZ8MTXP02IKEY4.4.27.C05.1.454.CMB.2.raw
  modified_base (302)..(302): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccacctcactgtccgtgtccccaggacagacacgccacctacttacctgtctctaggaaatgtaattggactagtattaagtttgtgttgttaggtatacgaagtggacggccgacggcctaccgttccccttnttttagctattggtagtacgggataaggaaacgccggaccctgacgggtactcccgtggacgtccgtcttcgtcgtacggtactacccgaacgtcggtacgggaaaccacgaccgtcccgtaactcgtacgacctagtaccgtacgggaccggtaaacccttaaacgttttacgacggttacggaacggtaccgtacttactttcgtacgtaccgtacgtacgggtacggacgtacggtcgggactcgtagtacgtacgttcggtacgggacgggtaacgggaccaggccgtacggaccgttccgcgggtaccacggaacccgtaacggtccctcccggtaccccgtcggtacctaccgtttcccg

SEQ ID NO: 439910 - DNA, 647 bp, Homo sapiens
  misc_feature: GZ8MTXP02JEDS6.4.27.C05.1.454.CMB.2.raw
  modified_base (304)..(304): a, c, t, g, unknown or other
  modified_base (408)..(408): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccttcttatgagctgactcacgcccacctcactcgtccgtcgtccccaggacagaccacgcccacctattacctgctcgtaggaaatgaattggacagtagttaagtttgtgttgttacggatacgaaggtgacggccaggccctacgtccccttntttacgctagtgtacgtcggataggaacgccggtccctagaggtacttccgaggactccccgtctttctacgtaggtacctacctaacgtccgagggtaaaccncgaccgtaccctacgtacgtacaacccgtactaccgacggtacccggtaaccttaaacgttttacgacgtacggaccgtacgtacttcgtttacgtcgttaacgacgtacggtacggacggtacgtcggggactacgtcggtacgtccgtacgtcgggacggacgggaacctagccgtacgaccggttcggacgcgaccgccgacggtccctacggcccctcggtacctacgttccccg

SEQ ID NO: 439911 - DNA, 717 bp, Homo sapiens
  misc_feature: GZ8MTXP02GDDP3.4.27.C05.1.454.CMB.2.raw
  modified_base (218)..(218): a, c, t, g, unknown or other
  modified_base (690)..(690): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagtctgactcacgcccacctcactcgtccgtcgtcccaggacagacacgccactattaccngtctacgtaggaaatgtaattggactaagtagttaggtttggtgttaggttaggtatcgtaaggtcggacggtaccgaggtacccctacgttccccctttagttttaacgcgttaagttggtaacggtaccgggtaaattaacgggaaccgtcccgggtacctacggagggtacctccgtaggacgtcccgtcttcgtcgacggttacctaccgaaacgttcgggaaacggaaacctacgaccgtaccctaacgttacgactaaaccctagtacccgacggggtaacccccgtaactttaaacgttttacgacgtacggaacccggtaccttacgtttacgttaccgtcgtaaacgtacggttacgtacgggtaacctaggtccgggtactccgtaggtacgtacgtccgggtacgggacggacgtaccgtagtccggtacgtccggtacgcgggtaccacggtcacggtcncccggtcccgtggtaccctcgttcccg

SEQ ID NO: 439912 - DNA, 634 bp, Homo sapiens
  misc_feature: GZ8MTXP02GMEA5.4.27.C05.1.454.CMB.2.raw
  modified_base (287)..(287): a, c, t, g, unknown or other
  modified_base (387)..(387): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccacctcactgtccgtgtccccaggacagacagccaccattacctgactctaggaatgaattggacagtattaagttgtgttgttgtatcgaagtgacggccaggccacgtccccttntttagctatgtagtcggaatacggaagccggacctgagggtactccgtggacgcccgtcttactgtacggtctaccaactccgtacgggaaacaccgacncccgtaactcgacgaccatccgacgaccggtaacctaactttagagttcggacggtaccgtacttactttcgaccgttacgaaccgtacggttacgggaccgtagttaccgggactacggtcgacggttacgtccgggttcggggaccgggtaacgggaccgtaacggtcgttaccggtacccgtacggtcggacccgacggaacccgaacggtccgcccggtcccgtacggtacctccgtttcccg

SEQ ID NO: 439913 - DNA, 642 bp, Homo sapiens
  misc_feature: GZ8MTXP02ICFFJ.4.27.C05.1.454.CMB.2.raw
  modified_base (152)..(152): a, c, t, g, unknown or other
  modified_base (215)..(215): a, c, t, g, unknown or other
  modified_base (248)..(248): a, c, t, g, unknown or other
  modified_base (286)..(286): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctnttatgagctgactcagcccacctcactcgtccgtcgtcccaggacagacacgccacattaccngctcgtaggaatgaattggacagtattagttgngttgtgtatcgagtgacgccacggcctacgtccccttntttagctatggtagtacggtataacggaacggcccggcctagacggtactccggtagcgtcccgtcttctacgtacgactacccgaattccgggtaacgggaacctacgacgtccctaacgtcgtacgacctagaccgacggtacccggtaaaccttacgtttagacgttacggacgtaaccgtacttactttcgtaccgtacaccggtacggacgggaccgtaggtcggacctacggtcgacgtcgttccggtacgggacgggtaacgaacgacgtcgtacggtcccggtccggtcggtacgaccgtaaccggaacggtcccgtcccgtacccgtccggttactcccgtttcccg

SEQ ID NO: 439914 - DNA, 603 bp, Homo sapiens
  misc_feature: GZ8MTXP02JUQCS.4.27.C05.1.454.CMB.2.raw
  modified_base (152)..(152): a, c, t, g, unknown or other
  modified_base (296)..(296): a, c, t, g, unknown or other
  modified_base (338)..(338): a, c, t, g, unknown or other
  modified_base (595)..(595): a, c, t, g, unknown or other
tcagagcactgtagcacgaccggtgctcgatttagacgcgatcgaaggggtttggggctgggcctcaggaagcagcatcggaggtgcctcagccatggcatggatccctctcttcctcggctccttgcttactgcacaggatgcgtgacctnttatgagctgactcagcccaccctcactgtcccgtcgtccccaggacagacacgcccacctattacctgctcgtaggaaatgtaattggacagtattaaggttgtgttgtgtatgaagtgacgcaggccacgtccccttatttnctatgtagacggatagaacgccgcctagacgggtactcccgnggacgccgtccttatcgtggtactaccgactcggtaacgggaaccacgaacgcctacgtcacgaccatcgacggcccggtaacccttaagtttagagtacggacgggtacctattacgtttcgaccgttacaccggtagggttaggaccgtaggtccggacctagtcggccgtaagttccgggacggacgggacggactacggcgtccggaccgtcgtccggacgccgaacgacggtcctcccggcccgtccgtacncttccccg

SEQ ID NO: 439915 - DNA, 554 bp, Homo sapiens
  misc_feature: GZ8MTXP02HI5PB.4.27.C05.1.454.CMB.2.raw
  modified_base (153)..(153): a, c, t, g, unknown or other
  modified_base (215)..(215): a, c, t, g, unknown or other
  modified_base (283)..(283): a, c, t, g, unknown or other
  modified_base (412)..(412): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgaccctnttatgagctgactcagccaccctcactgtccgtgtccccaggacagacagccaccattaccngctctggaaatgaattggacagataagtttgtagtgttggtatcaagtgaggccaggccagtcccctntttagcatgtatcggatagaagcgccctgaggatccctgagccgcttctcgtggatcccaactcgtagggacacagccactctgaccatcagcggaaccctaactttagatgacgtccgactatttcgngttacacgtacgtgggacagtgggcacgtggcgatccggttcgggacgggaacgggacccaaagccgttacggacccgtccgtcgggtaccgacggaacccgaacgggcctcccggtcccccgtcggtcctaccgttccccg

SEQ ID NO: 439916 - DNA, 664 bp, Homo sapiens
  misc_feature: GZ8MTXP02ITHE5.4.27.C05.1.454.CMB.2.raw
  modified_base (217)..(217): a, c, t, g, unknown or other
  modified_base (284)..(284): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagcccaccctcactgtcccgtcgtccccaggacagacagccaccattaccngctctaggaaatgaattggcagtattagtttgtagttgtgatcgaagtgagccaggccagtcccctntttagctatgtagtggataaggaaacgccgcctcgaggactcccgagacgcccgacttcgcgtacggacttacccgaagttcgtacggggaaaccaaccgcgtacccaacgttcacgaccctagtaccacggaccggaaccctaaagtttacgagttacggacgtaccgtacttaacgtttcgtacgtacgtacgtacggtagggaccgtagtacgggcctacgtggcgtaacgttccggtacggggacggaaccggggtaccaacggtccgttaaccggacccggttcccggtaacgggggtacccgaaccggtaaccccggaaacggtccccgtaccggtacccccccgtcgggtaacccttacccggtttaaccccg

SEQ ID NO: 439917 - DNA, 687 bp, Homo sapiens
  misc_feature: GZ8MTXP02JTQKP.4.27.C05.1.454.CMB.2.raw
  modified_base (221)..(221): a, c, t, g, unknown or other
  modified_base (359)..(359): a, c, t, g, unknown or other
  modified_base (371)..(371): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcacgcccaccctcactcgtccgtcgtccccaggacagaccacgccacctattaccngctacgtaggaatgaattggcaagtattagttgtgtgttgatcgaagtgaggccacggcctacgttcccccttagttttacgctagtggtagtacgggtaataacggaaacgcccggcccgtagacgggtacctccgnggacgtcccgtnttccgtcgtacggactaccgaacgtcggtaacgggactaccgacgtcctactacgtcacctagtacgacggaccggtaccttaagtttagcgtacggacgttccgactttactttccgacgtaccacggtcgggtggacgtaggtccgggactcgacgggtctacgggttcgtacgggggcggaacggggtaccctaacggcggttaacccggtacccgggtttaccggacgggttcccggaacggtaacccccgggtaacggtccccggtttaccccgtcccccggggtcgttacccgttcccggtttacccccg

SEQ ID NO: 439918 - DNA, 577 bp, Homo sapiens
  misc_feature: GZ8MTXP02JP833.4.27.C05.1.454.CMB.2.raw
  modified_base (151)..(151): a, c, t, g, unknown or other
  modified_base (175)..(175): a, c, t, g, unknown or other
  modified_base (185)..(185): a, c, t, g, unknown or other
  modified_base (255)..(255): a, c, t, g, unknown or other
  modified_base (282)..(282): a, c, t, g, unknown or other
  modified_base (290)..(290): a, c, t, g, unknown or other
  modified_base (294)..(294): a, c, t, g, unknown or other
  modified_base (338)..(338): a, c, t, g, unknown or other
  modified_base (342)..(342): a, c, t, g, unknown or other
  modified_base (392)..(392): a, c, t, g, unknown or other
  modified_base (443)..(443): a, c, t, g, unknown or other
tcagagcactgtagcacgaccggtgctcgatttagacgcgatcgaagggtttggggctgggcctcaggaagcagcatcggaggtgcctcagccatggcatggatccctctcttcctggcgtccttgcttactgcacaggatgcgtgacctnttatgagctgactcagccaccctnactgtccgtntccccaggacagacagccaacattacctgctctaggaaatgaattggacagataagttgtgtgttggtancaaagtcgaggccaggcacgtcccctnttttacgnagtntagtacggattaagaaacgtccggccctagagggacttacccgngacnccgtctcgtgtacgatccaaactcgtggaaactcgaacgccaatcgtaanaaccagcacgcgggaacctaacgtttagatacgacggactattattcgtanacacgtagaggatagcgacgacgtcgacgtagtaccggtaggacggtaacggacgtacgccgtaccgtaccggtacgtacggtaccaacggaacccgtaaggcccgtacccggccccgtacgtacctacgtccg

SEQ ID NO: 439919 - DNA, 583 bp, Homo sapiens
  misc_feature: GZ8MTXP01A0WQ5.45.60.F05.1.454.CMB.2.raw
  modified_base (390)..(390): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagttgggcttagctgggttttccttgttgctatttaaaggtgtccaatgtgaagtgcagctggtggagtcgtgggggagacttggtacagccagggcggtccctgagagtctcctgtatagcttctggattctacctttggtgtattatactatgacctgggtccgccaggctccaggggaaggggctggagtgggtggggtctcattagaagcaaagcttcgtggggggacaacgagactacgccccgcgtctgtgaaaggcagnttcaccatctcaagagatgattaccaaaagtgtcgccatctgacaaatgaacagacctaggaaaaccgaggaaccacgagccatgtatactagtactaggaggggtggtcgcgtgttccggtaactccccgacgttcgttcggggcccacggggtaacccctggggtaccttaccgtccgttcccgtaacccg

SEQ ID NO: 439920 - DNA, 624 bp, Homo sapiens
  misc_feature: GZ8MTXP01B0NM2.45.60.F05.1.454.CMB.2.raw
  modified_base (203)..(203): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagttgggcttagctgggttttcctgttgctattttaaaggtgtccaatgtgaagtgcagctggtggagtcgtggggganacgttggtacagccgagggccggtcctgagagtctctgtatagtcttctggtattctacgtttggtgtattatactatgacctgggtccgcgaggctccgagggaaggggcgtgggaggtggggtgggtctacgtagttaggaaagacgaaagtcgttcggtaggggggacaacgagactacggccccgcgtcgtgtagaaggcagcttcaccatctacaagagatgtacttaacgaaacgtgtaccgaccatctagacaaagtacgaacacgactaacgggaaacgaggaacacgacaccgtatcgtaattactgtaacgtagggtcggggtaagggtcgcgttcggaccgtaaccgtccttaccgttcggttcggggccacgggtaacccgtcggtcccgttaccgtccgttccctccg

SEQ ID NO: 439921 - DNA, 780 bp, Homo sapiens
  misc_feature: GZ8MTXP01CEILI.45.60.F05.1.454.CMB.2.raw
tcagacgcgatcgacacgaccggtgctcgatttagtacgtcatcaggggaaaggggaagactgacggtcctgccacaggtggtgctgggcacggtgggcactcgacacagaccaccaaccatggagttgggcttagctgggttttccttgttgctattttaaaggtgtccaatgtgaagtgcagctggtggagtcgtgggggagacttggtacagccgagggcggtccctgagagtctcctgtatagcttctggtattccactttggtgtattatactatgaccgtgggtccgccaggctccgagggaagggcgtggaggtgggtgggtctcgagttaagaagtacaaagtcgttcgtaggggggaacaacgagacgtacgccccgcgtcgtggtagaaacggcaagtcttccgaacctagtacctacgaaagagatacgtacttaaccgaaaagttcgtacccgacccgtattaccgttacgaactaaacgtacgaaacgaacgtaccccgttaaaacgggggaaaaaaccccggaaggggaaacccctaaaccggaaccggtaacccctaacgtttaaggttttaaaccgtttaccgttaaagggtttaaaccgttaagggggtaacggggggttaaacggggttcggttaccggttaccgggttaccccggttaaacccgtccccgttaacggttaccggttaccggggtaacccggtaaaccggggtaaccccgttcgggtaccccgttacccgggttcccttcccgtaaccccgg

SEQ ID NO: 439922 - DNA, 433 bp, Homo sapiens
  misc_feature: GZ8MTXP02G3PJC.45.60.F05.1.454.CMB.2.raw
  modified_base (395)..(395): a, c, t, g, unknown or other
  modified_base (428)..(433): a, c, t, g, unknown or other
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccaggggaaccctggtcaccgtctcctcagcctccaccaagggccccatccggtctccccctggccgccctgcctccaggacgccacctccgagacgcacagcccggccctgggctgcctggtcaggctacttccngatcgcgtctgagcggctggcaaggcgcatagnnnnnn

SEQ ID NO: 439923 - DNA, 426 bp, Homo sapiens
  misc_feature: GZ8MTXP02F6PY8.45.60.F05.1.454.CMB.2.raw
  modified_base (423)..(426): a, c, t, g, unknown or other
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccaggggaaccctggtcaccgtctcctcagcctccaccaaggccccatcggtcttccccctggcgccctgctccaggagcacctccgagagcacagccggccctgggctgcctggtcaggctacttcctcgatcgcgtctgagcgggctggcaaggcgcatagnnnn

SEQ ID NO: 439924 - DNA, 621 bp, Homo sapiens
  misc_feature: GZ8MTXP02GVHAI.45.60.F05.1.454.CMB.2.raw
  modified_base (387)..(387): a, c, t, g, unknown or other
  modified_base (442)..(442): a, c, t, g, unknown or other
tcagacgcgatcgacacgaccggtgctcgatttagtacgtcatcaggggaaagggaagactgacggtcctgccacaggtggtgctgggcacggtgggcactcgacacagaccaccaaccatggagtttgggcttagctgggttttccttgttgctattttaaaggtgtccaatgtgaagtgcagctggtggagtctgggggagacttggtacagccagggcggtccctgagagtctcctgtatagcttctggattcacctttggtgtattatactatgacctgggtccgccaggctccgagggaaggggctggagtgggtgggtctcgattagaagcaaagcttcgtgggggacaacgagactacgcccgcgtctgtagaaggcagnttcacatctacaagagatagattaccgaaaagtcgtacgcccaatcctgacaaanagaacgaacgaccgtaacgaaaccgaacggaacgaacgaacgaccactagttagttaacgttagtacgtaaggtaggggtaagggtacggtcgtcggttaccggtaaccgtacccgtaccgtaccgtacgggaaccggacggaacccggtacggtaccgaccggtaccgtaccgtcccg

SEQ ID NO: 439925 - DNA, 438 bp, Homo sapiens
  misc_feature: GZ8MTXP02HWOON.45.60.F05.1.454.CMB.2.raw
  modified_base (417)..(417): a, c, t, g, unknown or other
  modified_base (433)..(438): a, c, t, g, unknown or other
tcagacgcgatcgacacgaccggtgctcgatttagtacgtcatcagggaaggggctggagtgggtgggtctcattagaagcaaagcttctggggggacaacagactacgccgcgtctgtgaaaggcagattcaccatctcaagagatgattccaaaagtgtcgcccatctgcaaatgaacagcctagaaaaccgaggacacagccatgtattactgtactaggaggggtaggtcgctgtccggtaactcccactacgtggggccagggaaccctggtcaccgtctcctcagcctccaccaagggccccatcggtcttccccctggccgccctgcctccaggacgcacctccgagagccacacgccggcccctggggctgcctggtcagggctacttcctcgatcgcgtctgagcggntggcaaggcgcatagnnnnnn

SEQ ID NO: 439926 - DNA, 592 bp, Homo sapiens
  misc_feature: GZ8MTXP02IK3QX.45.60.F05.1.454.CMB.2.raw
  modified_base (384)..(384): a, c, t, g, unknown or other
  modified_base (447)..(447): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctattttaaaaggtgtccaatgtgaagtgcagctggtggagtcgtgggggagacttggtacagccagggcggtcctgagagtctcctgtatagcttctggattcacctttggtgattatactatgacctgggtccgccaggctccgagggagggctggaggtgggtgggtctcattagaagcaaagcttcgtgggggacaacgagactacgccccgcgtctgtagaaggnagattcaccatcctacaagagatagtataaccaaagtcgtaccgaccctatctagaactaaanagaacacgacctaaagaaaccggacgacacacgccagtagtattacgtcgtagaggggtagggtacggtcgcgtcggtaccgtacctccgtacgtacgtcgggaaccgacgggtaaccgtcggtaccgtaccgtccgtcctaccg

SEQ ID NO: 439927 - DNA, 617 bp, Homo sapiens
  misc_feature: GZ8MTXP02IIBQU.45.60.F05.1.454.CMB.2.raw
  modified_base (401)..(401): a, c, t, g, unknown or other
  modified_base (432)..(432): a, c, t, g, unknown or other
tcagacgcgatcgacacgaccggtgctcgatttagtacgtcatcaggggaaaggggaagactgacggtcctgccacaggtggtgccgggcacggtgggcactcgacacagaccaccaaccatggagtttgggcttagctgggttttccttgttgctattttaaaaggtgtccaatgtgaagtgcagctggtggagtctggggggagacttggtacagccagggcggtccctgagagtctcctgtatagcttctggattcacttttggtgattatactatgacctggtccgccaggctccagggaagggctggagtgggtggtctcattagaagacaaaagcttcgtgggggacaaacaggactacgcgccgtctgtgaaaggcagattcacatctcaaganatgatacaaaagtgtcgcatctgacaaatanaacaagactacgaaacgaaacgaacgaacaacgacactagtattaactacgtaacgtaaggtaaggggtaaggggtacggtacgtacggtaccggttaaaccgttacccgtacccgtaccgttacgggaccggaaccgggtaacccggtaccggtaccgtaaccggtccgtcccttaccgacccg

SEQ ID NO: 439928 - DNA, 566 bp, Homo sapiens
  misc_feature: GZ8MTXP02FF9DP.45.60.F05.1.454.CMB.2.raw
  modified_base (268)..(268): a, c, t, g, unknown or other
  modified_base (376)..(376): a, c, t, g, unknown or other
  modified_base (388)..(388): a, c, t, g, unknown or other
  modified_base (427)..(427): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctattttaaaaggtgtccaatgtgaagtgcagctggtggagtctgggggagacttggtacagccagggcggtccctgagagtctcctgtatagcttctggattcaccttttggngtattatactatgacctgggtccgccaggctccagggaaggggctggagtgggtgggtctcattagaagcaaaagctctggggggacaacgagactacgcccgcgtcngtgaaaggcagntcacatctcaagagatgattaccaaaagtgtacgcccanctgacaaatagaacagcctagaaaccgagacacagccatgtattactgtactagaggggtagggtcgcgtcgtccggtaactccccgaactacgtcggggccgaacgggaacccgtcggtccgaccggtctccctaccg

SEQ ID NO: 439929 - DNA, 627 bp, Homo sapiens
  misc_feature: GZ8MTXP02GUL0D.45.60.F05.1.454.CMB.2.raw
  modified_base (388)..(388): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctattttaaaaggtgtccaatgtgaagtgcagctggtggagtctgggggagacttggtacagccagggcggtccctgagagtctcctgtatagcttctggattcacctttggtgattatactatgacctgggtccgccaggctcgagggagggcgtggagtgggtgggtctcgattagaagcaaagcttcgtggggggacaaacgagactacgccccgcgtctgtgaaggcagnttcacatctacaagagatgattaccgaaaagtcgtaccgcccatcgtgacaaatacgaacacgtacctaacggaaaaccggaaggaaccaacgacgacccagttacgttaattaaccgtagtaacgtagggtagggggtaacgggtccgtcgttcggtacccggttaacctcccgtaccgtacggtcggggaacccgacggggtaaccctcgggtacccacccggttacctccctaccg

SEQ ID NO: 439930 - DNA, 654 bp, Homo sapiens
  misc_feature: GZ8MTXP02G97UQ.45.60.F05.1.454.CMB.2.raw
  modified_base (206)..(206): a, c, t, g, unknown or other
  modified_base (394)..(394): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctattttaaaggtgtccaatgtgaagtgcagctggtggagtcgtgggggganacttggtacagccgaggggcgtccctgagagtctcctgtatagcttctggtattccaccgtttggtgtattatactatgacctgggtccgcaggctccgagggagggctggagtgggtgggtctcgagttagaagcaaagtcttcggtgggggacaacgagactacgccccgcgtcgtgtgaagcagntcacatcacaagagatagaattaccgaaaagttcgtccgaccctagtccttaggaacctaaatacgaacgacgacccgtaacggaaaaccgaggaaccaacaacgaccgtatagttacttaacgttacgtaacgtaggggtagggggttacgggtacgtcggtacggttaccccggtaacgtaccccgaaacttaccggggtacggggaacccggtaacggggtaacccgtcgggtacccgtaccggtcctcccgtaccg

SEQ ID NO: 439931 - DNA, 643 bp, Homo sapiens
  misc_feature: GZ8MTXP02JQC1Y.45.60.F05.1.454.CMB.2.raw
  modified_base (205)..(205): a, c, t, g, unknown or other
  modified_base (414)..(414): a, c, t, g, unknown or other
tcagacgcgatcgacacgaccggtgctcgatttagtacgtcatcaggggaaaggggaagactgacggtcctgccacaggtggtactgggcacggtgggcactcgacacagaccaccaaccatggagtttgggcttagctgggttttccttgttgctattttaaaggtgtccaatgtgaagtgcagctggtggagtcgtggggganacgttggtacagccgagggcggtccctgagagtctctgtatagcttctggtattctaccgttttggtgtattatactatgaccgtggtccgccaggcctccgaggggaaggggcgtggaggtggggtggtcgtctagttagaagcaaaaggcgtttcggtagggggtacaaacgagactacggccgccgtctgtgaagcagattcaccntctacaagagatgtaacttaccgaaaagtcgtccgacccatctaggactaaaagtcgaaacgacgacccgtaacggaaaaccggacgggaaccaacgacggaccagttacgtattaccgtgttaacgtaggggaggggtaggtccggtcgtacggtccggtaacctcccgacttaccgggcgggaccgaacgggaaccgtcggtacctcccggtcctcccgtcgacccg

SEQ ID NO: 439932 - DNA, 636 bp, Homo sapiens
  misc_feature: GZ8MTXP02I06LK.45.60.F05.1.454.CMB.2.raw
  modified_base (349)..(349): a, c, t, g, unknown or other
tcagacgcgatcgacacgaccggtgctcgatttagtacgtcatcaggggaaaggggaagactgacggtcctgccacaggtggtactgggcacggtgggcactcgacacagaccaccaaccatggagtttgggcttagctgggttttccttgttgctattttaaaaggtgtccaatgtgaagtgcagctggtggagtctgggggagacttggtacagccagggcggtccctgagagtctcctgtatagcttctggattcaccttttggtgattatactatgaccgtggtccgccaggctccagggaagggcgtggaggtggggtggtctcagttagaagcaaagcttcgngggggacaacgagactacgccgccgtcgtgtgaaaggcagacttcaccatctacaagagatgtaattaccgaaaagtcgtcgccagtctgacaaatagaaacgacgaaccgtacgaaaaaccggacggaaccaccgaacggccctaagttaggttaacttacgttacgtaacgttaagggacgggggttaacggtcggacgttcggtacccgggttaaacctccccgtactaccggtcgggaccgaacggtacccgtcggtaccaccgtacctcccgtacgtacccg

SEQ ID NO: 439933 - DNA, 644 bp, Homo sapiens
  misc_feature: GZ8MTXP02FXMWT.45.60.F05.1.454.CMB.2.raw
tcagacgcgatcgacacgaccggtgctcgatttagtacgtcatcaggggaaaggggaagactgacggtcctgccacaggtggtactgggcacggtgggcactcgacacagaccaccaaccatggagtttgggcttagctgggttttccttgttgctattttaaaaggtgtccaatgtgaagtgcagctggtggagtcgtggggggagacttggtacagccgagggcggtccctgagagtctcctgtatagcttctggattctacctttggtgtattatactatgacctggtccgcaggctcgagggagggctggagtgggtggtctcattagaagacgaagtcgttacggtagggggacaaacgagactacggccgtcgtcgtgtagaaacggcaagacttcacctatctacaagagtatagtaattaccgaaaagtcgtaccgccatcacgtaacaaacgtcgaaacgacgaccgtaagaaaaccgacggaaccacgacgaccctatagttaacttacgtagtaacgtagggtacgggggtacggtacgtcgttacggtaccgtaaccgtcccgtaacgtaccggtcggggacccgtaacgggtaacccgtcggtacccgtaccgtccgtaccgacgtacccg

SEQ ID NO: 439934 - DNA, 647 bp, Homo sapiens
  misc_feature: GZ8MTXP02FXJY4.45.60.F05.1.454.CMB.2.raw
  modified_base (205)..(205): a, c, t, g, unknown or other
  modified_base (291)..(291): a, c, t, g, unknown or other
  modified_base (465)..(465): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctattttaaaggtgtccaatgtgaagtgcagctggtggagtcgtggggganacttggtacagccagggcgtcctgagagtctctgtatagcttcgtggattcactttggtgtattatactatgaccgtgggtccgcnggctccgagggaggggctggagtgggtgggtctcattagaagcgaaaagtcgttacggtgggggaacaacgagaaccgtacggccccgtcgtcgtagtagaaaggcagtagttccaccgtatctacaaagagatagaattaaccaaaagtgacccgcctaatctagaactaaanagaacagaaccgtaagaaaaccgaggacaacacgaccatagtaactttacgagtaagaggggtagggtacgggtcgtacgtacggtaaccgggtaaccctacccgtaacgtaccggttaccggggaaccgtaaccggggtaaccctcggggtaccctaacccggtcccgtttacctaacccg

SEQ ID NO: 439935 - DNA, 641 bp, Homo sapiens
  misc_feature: GZ8MTXP02H9HVP.45.60.F05.1.454.CMB.2.raw
  modified_base (422)..(422): a, c, t, g, unknown or other
  modified_base (475)..(475): a, c, t, g, unknown or other
  modified_base (638)..(638): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgcttattttaaaaggtgtccaatgtgaagtgcagctggtggagtcgtgggggagacttggtacagccgagggcgtccctgagagtctcctgtatagcttctggattctaccgtttggtgtattatactatgacctgggtccgccaggctccgaggggaacggggcgtgggaggtggggtgggtctcgaagttaggaagacgaaagtcgttacggtagggggacaaacgtacgacgtaccggccccgcgtccgtgtaggaaaggcaagtnttccactacgtctacaagagatagactacgaaagtcgtccgaccctatcgtanacaaatacgaacacgtacctaacgaaaacggagaacacgacgccaagtagtacttacgtgtacgtagggtacgggggttacggtcggtacgtcggtacccggtacctcccgacgttacggcgggtaaccgacgggaacccgtcggacccgtaccgtctacccnccg

SEQ ID NO: 439936 - DNA, 673 bp, Homo sapiens
  misc_feature: GZ8MTXP02HJ4I7.45.60.F05.1.454.CMB.2.raw
  modified_base (204)..(204): a, c, t, g, unknown or other
  modified_base (269)..(269): a, c, t, g, unknown or other
tcagacgcgatcgacacgaccggtgctcgatttagtacgtcatcaggggaaaggggaagactgacggtcctgccacaggtggtgctgggcacggtgggcactcgacacagaccaccaaccatggagtttgggcttagctgggttttccttgttgctatttaaaggtgtccaatgtgaagtgcagctggtggagtcgtggggganacttggtacagccagggcgtccctgagagtctcctgtatagcttcgtggtattcaccgttttggngtattatactatgacctgggtccgcaggctccgagggagggcgtggaggtgggtgggtctcgattaggaagacgaaaggctttcggtagggggacaaacgagacgtacgccccgcgtcctggtagaaaggcaagtcttcgactaatctacgaagacgtatagtattaacccaaaagtacgtccgaccctagtcctagacaaagtacgaacacgacctaaacgggaaaaccgtagggaaccaacgaacgacctagttagtactttacgtaggtaacgtaggggtacggggtaagggtccggtacgtcggttacccggtaaaccgtcccgtaacggttaccgacgggggtaaccccgaacggggtaccccgttacgggtaccgtacccggtcctaccccgttaccg

SEQ ID NO: 439937 - DNA, 759 bp, Homo sapiens
  misc_feature: GZ8MTXP01DEG4E.21.77.G11.1.454.CMB.2.raw
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtcccgccagggcctaccgagggcgaagggggtctggggacggtgggggtggctaggtttctaatcatagtgagtagggtaacgtttaataaaactcccgttaaagttcggaccgggtaccgttcccggggtagggaaaccgggggtacccgtaactttcccgaacccgtattacccgttaaccccgaaaggaacggtaaacctaaacctttaaccccgaaaacggaaaccctaacccggtaccgtttaggttaacttcccgttaggaccaaggtaacttacggaaaacccgacggtacccgttagggaacgggtaacgggtccgggttacggggggaaacccgaaccgggggttccctttaagggtttacctttaaacgttttaccgttagggtttaaccgggaaacggtaaaagggtacgttaaagggttgggggttaaccggttaagggtttaacgggggg

SEQ ID NO: 439938 - DNA, 561 bp, Homo sapiens
  misc_feature: GZ8MTXP01DT3RN.21.77.G11.1.454.CMB.2.raw
  modified_base (455)..(455): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcactgggtcccgccaggcctccgaggcaagggggctgggagtgggtggcagttctatcatatgatggacgttaataaatcctaatgacgactccgtgaagggccattcaccatctaccaagagaacaattaccaagaacacgctagtatcctagcaagactagaaacncgtacctaggacgaggcggtacggggacctaccggttcgttacgttacttaagttacgttaggtaagaacgtaaagtagtaggttggggtaagttaacggtaaggg

SEQ ID NO: 439939 - DNA, 545 bp, Homo sapiens
  misc_feature: GZ8MTXP01D9T8K.21.77.G11.1.454.CMB.2.raw
  modified_base (364)..(364): a, c, t, g, unknown or other
  modified_base (457)..(457): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtggggggagcgtggtccagccgtgggagtccctgagactctcctgtgcagcctctggattcaccttcagtagctatggcatgcacgtgggtcccgccaggctccgaggcaagggggctgggagtgggtgcagttctatcatatgatgggacttaanaaatcctatcgcggtactcggtagaacggcgtattcacatctacagacgacaattaccaaagaacacgcgtagtatcctgacagatagaaacncgccgtagacgaggcgtggggacacggttcgtagtcttaagttcgttagtaaggacgtaaaggtataggttgggtcgaaggtaagggg

SEQ ID NO: 439940 - DNA, 557 bp, Homo sapiens
  misc_feature: GZ8MTXP01AYMHF.21.77.G11.1.454.CMB.2.raw
  modified_base (258)..(258): a, c, t, g, unknown or other
  modified_base (299)..(299): a, c, t, g, unknown or other
  modified_base (334)..(334): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtcctgagctctcctgtgcagcctntggacttcaccttcagtagctatggcatgcacgtgggtccncaggcctccgaggcgaagggggctgggaggtgggngctagttctatcatatgataggaacttaataaatcctatcgcggtactcgtagacggcatcactatctaccagacgacaataccaaagacacgctagtaactctagacagatacgaacacgtacctaggaagaggtcggtacgggggaccgtacggccgttaggtaccttagttacgttggtaagaacgtaaagtagtaggttggggtaagttaaggtaaggg

SEQ ID NO: 439941 - DNA, 534 bp, Homo sapiens
  misc_feature: GZ8MTXP01DZGAC.21.77.G11.1.454.CMB.2.raw
  modified_base (302)..(302): a, c, t, g, unknown or other
  modified_base (337)..(337): a, c, t, g, unknown or other
  modified_base (348)..(348): a, c, t, g, unknown or other
  modified_base (366)..(366): a, c, t, g, unknown or other
  modified_base (460)..(460): a, c, t, g, unknown or other
  modified_base (527)..(527): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggacttcaccttcagtagctatggcatgcacgtgggtcccnccaggcctccgaggcgaagggggctgggagtgggnggcagttctancatatgataggacttaanaaatcctatcgcgactcgagagcatcacatcacagagacaattaccaaagaacacgactagttaactctagacagatagaaactagcctagagnggaacgtggggacacggttcgtaggtcttagttacgttgtaagaacgtaagtagtagttgggtaagngtaaggg

SEQ ID NO: 439942 - DNA, 610 bp, Homo sapiens
  misc_feature: GZ8MTXP01BQ4GV.21.77.G11.1.454.CMB.2.raw
  modified_base (254)..(254): a, c, t, g, unknown or other
  modified_base (261)..(261): a, c, t, g, unknown or other
  modified_base (302)..(302): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtncagcctntggattcaccttcagtagctagtggcatgcacgtgggtccnccaggcctccgaggcgaagggggctgggagtggggtgctagttctatcatatgatagggaactttaataaactcctaagtcggccggtactccggtaggaacgggccgtattaccacctatacctaccgaagaacgtaacaacttaccgaaagaaaccaccgtacgttagtaatccgtagaccaaggtatacgaaaccagcccgtaggaacggacggaacggtgggggaccgacgggttcgttcgttaacttagtttccgttaggttaacgaacgtaaagtagtaggttaggggtaagaaggtaaggg

SEQ ID NO: 439943 - DNA, 564 bp, Homo sapiens
  misc_feature: GZ8MTXP01B0A8I.21.77.G11.1.454.CMB.2.raw
  modified_base (301)..(301): a, c, t, g, unknown or other
  modified_base (341)..(341): a, c, t, g, unknown or other
  modified_base (356)..(356): a, c, t, g, unknown or other
  modified_base (379)..(379): a, c, t, g, unknown or other
  modified_base (433)..(433): a, c, t, g, unknown or other
  modified_base (455)..(455): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagctctcctgtgcagcctctggattcaccttcagtagctatggcatgcacgtggggtcccnccagggcctccgagggcgaagggggctgggaggtgggggngcagttctatcatangatagggacttaataaatcctancgcgactccgtgacgggccattcacatctacagagacaattaccaagaacacgntgtatctcgcaagatagaaacncgtcctaggaggaaggcggtgggggttacacgggttcttacggttacttagtttaccgttggttaacggtaacggaaaagtgtaaggttggggtgttaaggtaaggggg

SEQ ID NO: 439944 - DNA, 535 bp, Homo sapiens
  misc_feature: GZ8MTXP01BUF1G.21.77.G11.1.454.CMB.2.raw
  modified_base (260)..(260): a, c, t, g, unknown or other
  modified_base (302)..(302): a, c, t, g, unknown or other
  modified_base (337)..(337): a, c, t, g, unknown or other
  modified_base (460)..(460): a, c, t, g, unknown or other
  modified_base (469)..(469): a, c, t, g, unknown or other
  modified_base (480)..(480): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggattcaccttcagtagctatggcatgcacgtggggtcccnccaggcctccgaggcgaagggggctgggagtgggngcagttctatcatatgataggacgttaataaatcctatcggacggtactcggtagacgggcctattcacatctaccagacgacaacttaccaaagaacacgctagtatctagcagatagaacngcctagagngcgtggggacncgggctgtcttagttcttggtaagtacgaaagtgtagttggggtgaaggtaaggg

SEQ ID NO: 439945 - DNA, 694 bp, Homo sapiens
  misc_feature: GZ8MTXP01EMBA1.21.77.G11.1.454.CMB.2.raw
  modified_base (260)..(260): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggacgtcctgagctctctgtgcagcctntgacttcaccttcagtagctagtggacagtcgctacgtcgggtccgccaggcctacgaggcgaagggggtctaggggacggttgggggtacgcgtagtttactaagtcaattagtagtagttaacgggtaacttttaataaactcccgttaaagtcggggtacccgggtaccgttccgggtaagggaacggggtacccgtaacttaccaacctagttaccctaacccgaaggaaacaacctaaacttaccccgaaaaacgtaaaccgtaacccggttacgttacgttaacgtccgtacgaactaagtactaacgaaacgtcgtacgtaggacggcggtaacgggtacgggactacggttcgttacgttaacttaagttcgttaggtaacgaacggtaaagtaggttaggttagggtaacggttaaggtaacggg

SEQ ID NO: 439946 - DNA, 610 bp, Homo sapiens
  misc_feature: GZ8MTXP01DYPM6.21.77.G11.1.454.CMB.2.raw
  modified_base (260)..(260): a, c, t, g, unknown or other
  modified_base (304)..(304): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctctgtgcagcctntggattcaccttcagtagctagtggcatgctacgtggggtcccnccaggcctccgaggcgaagggggctgggaggtggggtgctagttctatcatagtgatagggtaactttaagtaaatccgtaagtcgccggtacgtccggtagggaacgggtccgtattaccaccacttctacccgagaacgaactaaacttaccaaagaaccacgtactagttaactcgtacgacaagatacgaaacagccgtaggagtaggcggtggggacctacgggttctaggttaccttaagtttccgttaggtaagtaaggtaaagttaggtaggttaggggtaacgttaaggtaaggggg

SEQ ID NO: 439947 - DNA, 506 bp, Homo sapiens
  misc_feature: GZ8MTXP01EJNO0.21.77.G11.1.454.CMB.2.raw
  modified_base (259)..(259): a, c, t, g, unknown or other
  modified_base (297)..(297): a, c, t, g, unknown or other
  modified_base (342)..(342): a, c, t, g, unknown or other
  modified_base (372)..(372): a, c, t, g, unknown or other
  modified_base (380)..(381): a, c, t, g, unknown or other
  modified_base (386)..(386): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggagcgtggtccagcctgggagtccctgagactctcctgtgcagcctntggattcacttcagtagctatggcatgcactgggtccnccaggctcaggcaaagggggctggagtggtgcagttctatcatangatggacttaataaatcctatgcgactcgngaagcgannacacnctacacacacgacactacacaacacacgacgtatactcgacgacgagaacgaacgacgacgacgacgacgacggcggacggaacggtacgtcgtacgttacttacttaacgttaagtaag

SEQ ID NO: 439948 - DNA, 657 bp, Homo sapiens
  misc_feature: GZ8MTXP01BMSRO.21.77.G11.1.454.CMB.2.raw
  modified_base (193)..(193): a, c, t, g, unknown or other
  modified_base (273)..(273): a, c, t, g, unknown or other
  modified_base (302)..(302): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggagcgtggtccagcctgggagtccctgagctctcctgtgcagcctctggacttcaccttnagtagctagtggcatgcacgtcgggtccnccaggctccgaggcgaaggggctgggagtgggtgctagttctagtcatatgatacggaacgttaataaactcctatcggtcggtacgtccggtaggacgggccgtacttacgaacctactcctaccgaagtaacgaacgtaaacttacccgaaagaaacgaccgtacttacggttacttacgtacgaaccgaagtaacgtacgtaaaccgacggtacccgtaagggacggtacgggtaacgggtacgggggaaccgtaccgggttacgttacggttacgttaacgtttaccgttaggttaacggacggtaaaaggttaaggtaggttaggggttaaggttaacgggttaaggggg

SEQ ID NO: 439949 - DNA, 658 bp, Homo sapiens
  misc_feature: GZ8MTXP01B8BHQ.21.77.G11.1.454.CMB.2.raw
  modified_base (264)..(264): a, c, t, g, unknown or other
  modified_base (306)..(306): a, c, t, g, unknown or other
  modified_base (528)..(528): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtgggacggtccccgagacccctctgtgcagcctntggattcaccttcagtagctatgacatcgcacgtgggtcccnccaggcctccgaggcgaagggggctggaggtgggtgcagttcatcaatatgattggaacgtttaaataaactcctaagtcggaccgggtactccggtagggaaacgggcccgtattccacctactcctaccaagtaacgaactaaacttacccaaaggaacctacgacgttacgttaacttccgttagacctaaggtaactaacggaaaccgacgttaccgngggtaaacggacggtaccgggtacgggggaaaccctaacggggttcttacggttcgttaaacgtttcgttaggttcgaaacggtaaagtagttaaggttgggggtagttaagggtgggaacggttaaccg

SEQ ID NO: 439950 - DNA, 767 bp, Homo sapiens
  misc_feature: GZ8MTXP01BCFNT.21.77.G11.1.454.CMB.2.raw
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggacgtcctgagactctcctgtgcagcctctggattccacttcagtagctagtggctatcgctacgtcggggtcccaccgaggcctaccggagggaccggtaaggggggccgttagggggacgggttgggggttacggccgtaaggttttcctaaagttccgtaaagtttaggtacggaagtttaaacgggggtaaacccttttaataaaacgttccccgttaaagttccgggaccgggtacccgttacccggggttagggaaaccgggggtacccgtaacttacccgaaccgtaaattcccgttaacccgaaagggtaaacgaaacccttaaaacggtttaaccccaaaacggtaaaaccctaccgggtactttacgggttaaactccttaacgggaccaaagggtacttaacgaaaccgtacgggtaccctagggaaagtaccggcgttaaaggggcgaaccggacgggtcttaccgttactttggttacgttaacgaggtaaacgtaagtaggttacggtggaaggtaaggg

SEQ ID NO: 439951 - DNA, 610 bp, Homo sapiens
  misc_feature: GZ8MTXP01EGPY6.21.77.G11.1.454.CMB.2.raw
  modified_base (268)..(268): a, c, t, g, unknown or other
  modified_base (282)..(282): a, c, t, g, unknown or other
  modified_base (292)..(292): a, c, t, g, unknown or other
  modified_base (312)..(312): a, c, t, g, unknown or other
  modified_base (435)..(435): a, c, t, g, unknown or other
tcagtcgtcgctcgcacgaccggtgctcgatttagctagtcactcaaggggaaagggggggagaggagcccagcactagaagtcggcggtgtttccattcggtgatcagcactgaacacagaggactcaccatggagtttggctgagcttgggttttcctcgttgcttcttttaagaggtgtccagtgtcaggtgcagcgtgggtggagtcgtgggggagcgtggtccagccgtggggacgtccctgagtactctcctgtgcagcctntggacttcaccttnagtagctagnggcatgcacgtcgggtcccncaggcctacgaggcgaagggggctgggaggtgggtcgctagttctatcaagtgtgatacgggtaactttaataaactcctaagtcgaccggtactcggtagacggctatcacatctacagtanactaataccaaagtaacaccgtacgttagtactcgtagacgtaagtaacgtacgaaacgtcgtaccgtaggacggacgggtaacggtacggggacgtacggttcgttacgttaacttacgttacgttaggtaacgaagtaaagtagtagggttagggtaacgttaaggtaacggg

SEQ ID NO: 439952 - DNA, 925 bp, Homo sapiens
  misc_feature: GZ8MTXP01BFSWY.21.77.G11.1.454.CMB.2.raw
  modified_base (260)..(260): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagctggtggagtcgtgggggagcgtggtccagccgtgggagtcctgagctctcctgtgcagcctntgattcaccttcagtagctatcggcagtgactacgttcgggggtccccaccgaggggtccctaccccgggaagggggtacccggtaaagggggggggccctttaggggggtaacgggttgggggggttcgggtacccgtaagggtttttccttaaaggttccgtaaatttaacggttagggtaaggtttaaacgggggtaaacccggtttttaattaaaaacccggttcccctttaaaggtccggggttacccggggtaacccgtttacccgggggttaagggggaaacccgggggtccccggtaaacttttaccccggaaacccgttaacgttacccttaacccccggaaaggttaaacggaaacccttaaaaccgtttaccccgaaaaaacgggtaaaccccaaaccggggttccctttaaggttaacctttccgtaacgggttaaccaaagggtaacctttaacgggaaaaacccgttacggtaccccgttaaggggaaggtaaccgggaaccgggttaacggggggaaccctaaaccggggttcccgttaagggtttaccctttaaacgttttaccggttaagggggtttaaccggaacgggtaaaaacggttaaggtttaaggggttacggggggttaagttaaacggggtttaaggggg

SEQ ID NO: 439953 - DNA, 672 bp, Homo sapiens
  misc_feature: GZ8MTXP01CZVCD.21.77.G11.1.454.CMB.2.raw
  modified_base (265)..(265): a, c, t, g, unknown or other
  modified_base (267)..(267): a, c, t, g, unknown or other
  modified_base (275)..(275): a, c, t, g, unknown or other
  modified_base (301)..(301): a, c, t, g, unknown or other
  modified_base (664)..(664): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggccgtggggacgtcccctgagactctcctgtgcagcctngnttcacttnagtgctatgacatgcagtcgggtccncaggcctcgaggcaagggggcttgggagtgggtgcagttctatcatgtgagtacggtaaactttaataaaacgtcccgttaaagtcgggacccggtaacgttcccgggtagggtaaaccgggggtccctaacgtttaccaacccgtaacttacccgtaccgaaacggtaaacggtaaaccctaaacgttaacccgaaaacggtaaaccgtaccgtacgtttacggtacttactacgggtacaaaggacttaagaaaccgacgtacccgtaggaacggtcggaacgggttcgggggaaccgtacgggttcgttaggttccttaaaggttcgttaggtaacgaagtaagtgtagttggggtaagnggtaaggg

SEQ ID NO: 439954 - DNA, 690 bp, Homo sapiens
  misc_feature: GZ8MTXP01EO7BJ.21.77.G11.1.454.CMB.2.raw
  modified_base (608)..(608): a, c, t, g, unknown or other
  modified_base (644)..(644): a, c, t, g, unknown or other
tcagtcgtcgctcgcacgaccggtgctcgatttagctagtcactcaagggaaaggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcagcgtgggtggagtcggtgggggaggcgtggtccaggccgtggggacgtccccgagaccctctgtgccagtcctcgtggtattccaccttcgagtagctaatcgactatcggacctacggtcgggtccctaccgagggcctccggaaggccgtaaagggggcgttagggggacgggttcgggggtacgggtacttacggttctaaacgtcgtaaattaagtaggtaagttaacggtaaaccggttttaaaaaataaaacgttcccgtaagtcgggtaccgggtacgttaccgggtagggaacgggtacctattaccgaactatccgtacaaggtaacaactaacgtaaccaaagaaccagtacgtacgtattcgaggaccaagtacgaagaaccgagtacgtagagtacggnggtacgggaacacgttcggtacttacgtagttacgnggttagacgtaaagtgtaaggtgggtacaggtaagggttcgtaacg

SEQ ID NO: 439955 - DNA, 624 bp, Homo sapiens
  misc_feature: GZ8MTXP01EYU82.21.77.G11.1.454.CMB.2.raw
  modified_base (261)..(261): a, c, t, g, unknown or other
  modified_base (303)..(303): a, c, t, g, unknown or other
  modified_base (344)..(344): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagctctcctgtgcagcctntggattcaccttcagtagctatggcatgcacgtcgggtcccncgaggcctaccggagggcgaagggggtctgggaggtggggngctagttctactcatagtgagtaggtacttaataaactccgatcgacgtacgtcgtaggacggccgtattaccactatcctaccaagacgtaactaacttacccaaagaccgtacgcttagtactctaggaccagagtacgaaacgcgtaccgtaggaacggcggtcgggtaccggggttaccgacgggttcgttaacggttaaccgttaacgtttccgttagggtaacgaaacgggtaaagtaggttagggttcggggtaaggttaacggtaacggggg

SEQ ID NO: 439956 - DNA, 612 bp, Homo sapiens
  misc_feature: GZ8MTXP01EF9W3.21.77.G11.1.454.CMB.2.raw
  modified_base (160)..(160): a, c, t, g, unknown or other
  modified_base (261)..(261): a, c, t, g, unknown or other
  modified_base (269)..(269): a, c, t, g, unknown or other
  modified_base (284)..(284): a, c, t, g, unknown or other
  modified_base (403)..(403): a, c, t, g, unknown or other
  modified_base (455)..(455): a, c, t, g, unknown or other
  modified_base (470)..(470): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttccncgttgcttcttttaagaggtgtccagtgtcaggtgcagctgggtggagtcgtgggggagcgtggtccagccgtggggacgtccctgagacttctcctgtcncagtcctntggtattccaccttnagtagctagtggcagtgcctacgtcgggtcccaccgagggcctaccgagggtaccgaaggggggtctggggaggtggggtcgactgttaccatctatagtgtaataagggtaacttaanaaactcccgaagtcgacgggtaaccttcgggaaggaggcctattaccactanctacgagacactaanaccaagacacgttgtagtctcgagacagacacgaacgacgtacgacgacggacggaacggtacgggacgtacgttacgttacgttacgttacgttacgttagtaagtaagtaagtagtaggttaggtaaggttaaggtaagg

SEQ ID NO: 439957 - DNA, 796 bp, Homo sapiens
  misc_feature: GZ8MTXP01D118I.21.77.G11.1.454.CMB.2.raw
  modified_base (253)..(253): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaaacacagaggactcaccatggagtttggctgagctgggttttcctcgttgctcttttaagaggtgtccagtgtcaggtgcagctggtggagtcgtggggagcgtggtccagccgtgggacgtccctgagctctcctgtncacgcctgtggacttcaccttcagtagctagtcggctatcgcctacgtcgggtccccgccagggccctacccggagggaccgaagggggtcgttagggacggttgggggtcgacgtaggtttcctaagtccaagtttacgtggtaacgttaacgggttaaacctttaacgtaaaacgtttccccgttaaagggttcccgggacccggggttacccgttacccgggggttaaagggaaaccggggtcccttaaactttaccccaaaccgttaacgttacccgttaccccgaaaaggtaaccgtaaaccttaaaaccttaacccgaaaaaggtaaaccccgttaaccgggtactttaacggttaactttaccccgaaggaacccgtaaaggaacgttaacgaaaacccgcggtaacccgtaggtaaacggaccgggtaaccgggttaacgggggaaaccgtcccggttacgttacggttaacttacgttaccgttaggttaacgaaagtaagtagtagggttacgggttaagaacggtttaaggg

SEQ ID NO: 439958 - DNA, 707 bp, Homo sapiens
  misc_feature: GZ8MTXP01BMLQA.21.77.G11.1.454.CMB.2.raw
  modified_base (194)..(194): a, c, t, g, unknown or other
  modified_base (263)..(263): a, c, t, g, unknown or other
  modified_base (306)..(306): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttggctgagcttgggttttcctcgttgcttcttttaagaggtgtccagtgtcaggtncagctggtggagtcgtgggggagcgtggtccagccgtgggacgtccctgagactctcctgtgcagcctntggacttcacttcagtagctagtgcatgactacgtcgggtccnccgaggcctccgaggcgaaggggctgggacgtgggtcgactaggtttcctatcagttagtcgtaagtacgggtaaccgtttaataaacgtcccgttaaagtcgggtaccggtacgttcccgggtaagggtaaccggggtcctaacttccaacctacgttacccgtaaccgaagtaacgaaacctaaacgttaccccaaaaggaaacctacccggttacgttaggttaaactccgttacggaacctaagtaacgtaccggaaacgtcgtaccggtagggaccggtaacgggtcggtaacggggaaccgtacggttccgttacggtttaacttacggtttccgttaaggttaaggaaaccgtaaaggttagtagggttaggggtaacgttaaggggtaacggg

SEQ ID NO: 439959 - DNA, 603 bp, Homo sapiens
  misc_feature: GZ8MTXP01AOJCU.21.77.G11.1.454.CMB.2.raw
  modified_base (260)..(260): a, c, t, g, unknown or other
  modified_base (281)..(281): a, c, t, g, unknown or other
  modified_base (299)..(299): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctntggattcacttcagtagctanggcatgcactgggtcccncaggctccgaggcgaagggggctgggagtggggtgctaggttctatcgattagtgtagtaacgggtaactttaataaaactcccgtaaagtcggtaccggtacgtccgggtaggtaacgggcccgtacttaccaacctactccgtaccaagtacgaaccaaacttacccaaaggaactacgaccgttagtactcgtagacaaggactacgaaacagtccctaggagacggcgtcgggggacaccggttcgttagtcttagttcgttgaaggtacgaaggtataggttagggtggaagtaagggg

SEQ ID NO: 439960 - DNA, 529 bp, Homo sapiens
  misc_feature: GZ8MTXP02J1206.21.77.G11.1.454.CMB.2.raw
  modified_base (252)..(252): a, c, t, g, unknown or other
  modified_base (259)..(259): a, c, t, g, unknown or other
  modified_base (269)..(270): a, c, t, g, unknown or other
  modified_base (272)..(272): a, c, t, g, unknown or other
  modified_base (275)..(276): a, c, t, g, unknown or other
  modified_base (280)..(280): a, c, t, g, unknown or other
  modified_base (295)..(295): a, c, t, g, unknown or other
  modified_base (298)..(298): a, c, t, g, unknown or other
  modified_base (300)..(300): a, c, t, g, unknown or other
  modified_base (305)..(305): a, c, t, g, unknown or other
  modified_base (307)..(307): a, c, t, g, unknown or other
  modified_base (310)..(310): a, c, t, g, unknown or other
  modified_base (318)..(318): a, c, t, g, unknown or other
  modified_base (323)..(323): a, c, t, g, unknown or other
  modified_base (327)..(327): a, c, t, g, unknown or other
  modified_base (386)..(386): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcgtggtttcgcgtaggctctttaagaggtgtccagtgtcaggtgcagctggtggagtctgggggaggcgtggtccagcctgggaggtccctgagctctcctgtgcngctctgntctctcagtnntntgnntgcncgtcggtcgcgcgcncgngngaggngnggnggtggtgngtgtntctnatatgagtagtagtataactactatgcgtacgtcgtacggacgacgtactacacactcncagacactactacaacgacgacactagtatctacgacgagagacgacgacgacgagagacggacggacgggacggacggtcgtacgtacgtacgttacgtagtaacgtacgtaacgtacgtaggtacggtacggtaggtacgg

SEQ ID NO: 439961 - DNA, 521 bp, Homo sapiens
  misc_feature: GZ8MTXP02GKW2V.21.77.G11.1.454.CMB.2.raw
  modified_base (298)..(298): a, c, t, g, unknown or other
  modified_base (346)..(346): a, c, t, g, unknown or other
  modified_base (507)..(507): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggacgtccccgagaccctctgtgcagcctctggattcaccttcagtagctatgacatgcactgggtccnccaggctccgaggcaaggggctgggagtggggtgctagtctatcatangatggacttataatcctatcggacgactccggtagaagggccgattcacatctcagagacataccaagacacgctagtatctgacagatacgaacacgctagagagtcgagggggacacggctgtactattacgtagtagacgaaagtagtagtggggtanacggtgggactacg

SEQ ID NO: 439962 - DNA, 602 bp, Homo sapiens
  misc_feature: GZ8MTXP02G8G1L.21.77.G11.1.454.CMB.2.raw
  modified_base (276)..(276): a, c, t, g, unknown or other
  modified_base (309)..(309): a, c, t, g, unknown or other
  modified_base (509)..(509): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtgggagtccctgagactctcctgtgcagcctctggattccaccttnagtagctagtggcagtgccacgtcggggtcccnccgaggcctccgaggccgaaggggctgggaggtgggtgctagtttcatcatagtgatggtaactttataaactcctaagtcgaccggtactccgggtaggaacgggtccgtacttccgaacctatccctaccgaagaacgtaaactaaacttacccgaaaacgaaaccacgtactagtactcgtagacagatacgaaacncgccgtagagtacgcgtagggacgacggtacgtcttacgttacttacgttacgtaagtacgaaacgtaaagtaggtaggtaggtacgtaaggg

SEQ ID NO: 439963 - DNA, 558 bp, Homo sapiens
  misc_feature: GZ8MTXP02JHT68.21.77.G11.1.454.CMB.2.raw
  modified_base (347)..(347): a, c, t, g, unknown or other
  modified_base (440)..(440): a, c, t, g, unknown or other
  modified_base (446)..(446): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggaggcgtgggtccaggcctggggaggtccctgagactctcctgtgcagcctctggattcaccttcagtagctatggcatgccacgtcggggccgccaggcctaccgagggcgaagggggctggggaggtggggnggctaggtttcatcatatgatggacttataaactcctaagtggccgtactccggagaacgggcctattccacatccacagacacaactcaaanaacacnctagtatctgacagatacgaacacgccgtagagaacggcggtacgggggaccacgggtcttggtactaacgttcgagtgaaacgaaagtagtaggtagggtagacggtaggg

SEQ ID NO: 439964 - DNA, 640 bp, Homo sapiens
  misc_feature: GZ8MTXP02JCOK0.21.77.G11.1.454.CMB.2.raw
  modified_base (353)..(353): a, c, t, g, unknown or other
  modified_base (423)..(423): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcagctggtggagtcgtgggggaggcgtgggtccagcctggggacgtccctgacgactctcctgtgcagtcctctggattccaccttcagtagctaagtggcatgcacgtggtccgcaggctccgaggcaaggggctggagtggggtgcagttcatcatntgatggacttataaatcctagtcgacgtactccggaggaacggggctattacacatccgtaccacggaanaacctaaacttaccgaaacgtaaacgaccggtatacgttactaccgtggtaacaaacggtaagtaacgaaacgaacgtacgtacggaacggaacgggtacgggtacggggaaccggtaccggtacggttacggttaacgttaacgtttaacggttacggtaacggtaaacggtaaaacggtaacggttaaggttacggggtacgggtaggtaacggg

SEQ ID NO: 439965 - DNA, 578 bp, Homo sapiens
  misc_feature: GZ8MTXP02IJYHU.21.77.G11.1.454.CMB.2.raw
  modified_base (282)..(282): a, c, t, g, unknown or other
  modified_base (313)..(313): a, c, t, g, unknown or other
  modified_base (428)..(428): a, c, t, g, unknown or other
  modified_base (440)..(440): a, c, t, g, unknown or other
  modified_base (459)..(459): a, c, t, g, unknown or other
tcagtcgtcgctcgcacgaccggtgctcgatttagctagtcactcaaaggggaaaggggggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcagcgtggtggagtcgtgggggagcgtggtccagccgtgggacgtccctgagactctcctgtgcagcctcgtggacttcaccttnagtagctagtggcatgcctacgtcgggtccncgacggcctaccgaggaccgaaggggctggggagtgggtcgctagttcagtacatatgatggtaacttataactcgtagtcgccgtactcgtagacggcatcacatctacagaanactaactacaanaacacgtactagtatacgngacagtactacgaacagtcgtagacgagtacggtacgggaactcggtacgtacgtaccgttaacgtttacgacggtaagaacgtaaaagtacggtaggtaggggtacgacggtaagggg

SEQ ID NO: 439966 - DNA, 504 bp, Homo sapiens
  misc_feature: GZ8MTXP02JRLOT.21.77.G11.1.454.CMB.2.raw
  modified_base (299)..(299): a, c, t, g, unknown or other
  modified_base (358)..(358): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtccnccaggctaccgaggcaaggggctgggagtggggtgcagttcatcatatgatggacttanaaatctatgcgactcgagagcatcacatctacagagacaatccaaagacacgctagtatctgacagatagaacagcctagagagcgtaggggacacggctagtctacgttacgtgtaagacgaaagtagtagtgggtagagtaggg

SEQ ID NO: 439967 - DNA, 504 bp, Homo sapiens
  misc_feature: GZ8MTXP02FX4IP.21.77.G11.1.454.CMB.2.raw
  modified_base (300)..(300): a, c, t, g, unknown or other
  modified_base (358)..(358): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggaggtccctgagactctcctgtgcagcctctggattcaccttcagtagctatggcatgcactgggtccnccaggctccaggcaaggggctgggagtggggtgcagttctatcatatgatggaacttnaaatctatcgcgactcgtgaaggcgatcacatctcagacgacaataccaagaacacgctagtatctgacagatgaacacgcctagagagcgtagggggacacggctgtctattactgtgacgaaagactaagtgggtagagtaggg

SEQ ID NO: 439968 - DNA, 586 bp, Homo sapiens
  misc_feature: GZ8MTXP02I732D.21.77.G11.1.454.CMB.2.raw
  modified_base (260)..(260): a, c, t, g, unknown or other
  modified_base (300)..(300): a, c, t, g, unknown or other
  modified_base (346)..(346): a, c, t, g, unknown or other
  modified_base (515)..(515): a, c, t, g, unknown or other
tcagtcgtcgctcgcacgaccggtgctcgatttagctagtcactcaagggaaaggggggagaggagcccagcactagaagtcggcggtgtttccattcggtgatcagcgctgaacacagaggactcaccatggagtttgggctgagctgggttttcctcgttgctcttttaagaggtgtccagtgtcaggtgcagctggtggagtcgtgggggagcgtggtccagcctggggagtccctgagactctcctgtgcagcctntggattcaccttcagtagctatggcatgcacgtgggtccnccaggcctccgaggcgaaggggctgggaggtggggtgcagttctancatagtgatggaacgttataaactcctagcgacgtactcggtaggaacgggccgtaattccaccactcctaccacgaacgtaactaacttaccaaacgaaccacggtctacgtactctagacaagacgtagaaacacgccgtaggagtacggacggtagggggaaaccncgggtacttacgttacgttaacgttacgtagtaaggaacgaaaagtacgttaggtagggtagacggtaggg

SEQ ID NO: 439969 - DNA, 731 bp, Homo sapiens
  misc_feature: GZ8MTXP02IGZ9A.21.77.G11.1.454.CMB.2.raw
  modified_base (303)..(303): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggagtccctgagactctcctgtgcagcctctggattcaccttcagtagctatggcatgcacgtgggtccnccgaggcctccgaggccgaaaggggctgggaggtggggtgcaggtttctaagtcaatagtggtaagtggtaaacgtttaataaaattccctaaagttcgggaccggtaccgtacccggttagggaaaacggggtcccgtaaacgtttcccgaaaccctaacgttaccccttaccccgaaaggtaaaccggaaaacgttaaaaccttaccccgtaaaaaacggtaaaacccctaaacccgggtacctttaacggtttaaactaccgttacgaacgtaaaacggtaactaaacggaaaccgtacgtacccgttaaggaacggtaacggtaccgggtaacggggaccgtaaccggtcgttacgttacgttaacgttacgtaggtaacgaaacgtaaaagtacgtaaggttaggggtagtacgggtaacggg

SEQ ID NO: 439970 - DNA, 578 bp, Homo sapiens
  misc_feature: GZ8MTXP02I9SS0.21.77.G11.1.454.CMB.2.raw
  modified_base (260)..(260): a, c, t, g, unknown or other
  modified_base (305)..(305): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggagtccctgagactctcctgtgcagcctntggattccaccttcagtagctagtggacatgacacgtgggtcccnccgaggcctccgaggcgaaggggctgggaggtgggtgctagttctagtcatagtgtataggtaacttataaactcctaagtcgacgtacgtccgtagaacggtccgattaccaccgtactcctacagaacgaactaactaccaaagaaccacgctagtatctagacaagataacggaacagcctagaggaacgtcggaggggacctaacgggtcttacggtaccttaagtaccgtggtaagaacgtaaagtagtaggtagggtagaggtaggg

SEQ ID NO: 439971 - DNA, 634 bp, Homo sapiens
  misc_feature: GZ8MTXP02G5AIG.21.77.G11.1.454.CMB.2.raw
  modified_base (259)..(259): a, c, t, g, unknown or other
  modified_base (299)..(299): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctctgtgcagcctnggattcaccttcagtagctatggcatgcacgtcgggtccnccgaggcctaccgaggcgaaaggggctgggaggtggggtgctaggtttcagtcatagtgtagtggtaacttagtaaactccttagtcggccggtacgtccggtaggaacgggtccgtattcccaaccgtacgttccctaccgtacgaacggtaacctaaacttacccgaaagtaaaccgaccggtacttagttacttccgacggaccaaggtatacgaaaccgacgtacccgtaggacgacgtacgggtacggggaccgaccgggtcttacgtaccttaacgttacctggtaacgtacggaaacggtacgttaggtagggtagtaaggttagggg

SEQ ID NO: 439972 - DNA, 573 bp, Homo sapiens
  misc_feature: GZ8MTXP02H27DE.21.77.G11.1.454.CMB.2.raw
  modified_base (282)..(282): a, c, t, g, unknown or other
  modified_base (304)..(304): a, c, t, g, unknown or other
  modified_base (419)..(419): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcagccgtgggagtccctgagactctcctgtgcagccctgtggattcaccttcagtagctagnggctatcggcacgtcgggtccncaggcctccgaggcgaaggggctgggagtgggtgctaggttctatcaatagtgagttggtacgtttataaactcctagtcgacgtactccggtagacgggcatcacatctacganacgaactaactaccaagaaccacgtactgttatctagacgtagatacgaacagtccgagaggacgtcggtaggggtaccacggtcgttacgttaccgtacgttacgtggtaacgaacgtaaaaggtacgttaggtacgggtagtaaggtacggg

SEQ ID NO: 439973 - DNA, 535 bp, Homo sapiens
  misc_feature: GZ8MTXP02GK94R.21.77.G11.1.454.CMB.2.raw
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtagctatggcatgcactgggtccgccaggctccgaggcaaggggctgggagtggggtgcagttctatcatatgatggaacgttataaactcctagtgacgtactccggtagaacgggccgtagttccaccatcctaccacgagaactaacttaccgaaagtaaacacgactagtatctagacagatagaacacgcctagagacgacgtggggacacggctacgtctatactgaagacgaaagagtagtggtagagtaggg

SEQ ID NO: 439974 - DNA, 524 bp, Homo sapiens
  misc_feature: GZ8MTXP02J1XZM.21.77.G11.1.454.CMB.2.raw
  modified_base (361)..(361): a, c, t, g, unknown or other
  modified_base (370)..(370): a, c, t, g, unknown or other
  modified_base (398)..(398): a, c, t, g, unknown or other
  modified_base (401)..(401): a, c, t, g, unknown or other
  modified_base (422)..(422): a, c, t, g, unknown or other
  modified_base (443)..(443): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggattcaccttcagtagctatggcatgcacgtgggtcccgcaggcctccgaggcgaaggggctgggagtggggtgctagttcatcatatgatggacttanaaatcctangcgactcgagaacggccgatcacatccncanagacaactaccaaagaacacnctgtatctgacagatagaacngacctagagagcgtaggggacacgggtctcgtactattacgtaggtaagaacggaaagattaaggtgggtagaggtacggg

SEQ ID NO: 439975 - DNA, 628 bp, Homo sapiens
  misc_feature: GZ8MTXP02JG26S.21.77.G11.1.454.CMB.2.raw
  modified_base (310)..(310): a, c, t, g, unknown or other
  modified_base (363)..(363): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccagccgtggggagtccctgacgactctctgtgcagcctctggacttccaccttcagtagctagtggcagtcgcacgtcgggtcccnccgaggcctccgaggcggaaggggctgggaggtggggtgctagttcatcatangataggacttataactctagcgaccgtactacggtaggaacgggtcctagttaccaaccgtattcccgtaccgaagaacgtaaacctaaacgttaccccgaaaagtaacccacggtcttacgtactccgtaggaccaagtatacgaaaccgtacgcctaggacgtacggcggtacgggggaaccgccggtacttcggttactaacgtttaccgaggtaacggtaaacggtaaagtacgtaaggttcggggtaagtaggtacgggg

SEQ ID NO: 439976 - DNA, 545 bp, Homo sapiens
  misc_feature: GZ8MTXP02GYHFE.21.77.G11.1.454.CMB.2.raw
  modified_base (299)..(299): a, c, t, g, unknown or other
  modified_base (363)..(363): a, c, t, g, unknown or other
  modified_base (451)..(451): a, c, t, g, unknown or other
  modified_base (453)..(453): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttcagtagctatggcatgcacgtgggtccnccaggcctccgaggcgaaaggggctgggagtgggtgctagttcatcatagtgatggaacgttanaaatcctaatcgacgtactccgtagaacgggccattcacatctacagacgaactaataccaaagaacacgctagtatcgtagacgaananacgaacgacgacgtacgagacgacggtacggacgacgacgtacgtacgtacgtacgtagtaagaacgaaagtagtagtaggtaggtagtagg

SEQ ID NO: 439977 - DNA, 654 bp, Homo sapiens
  misc_feature: GZ8MTXP02H75C1.21.77.G11.1.454.CMB.2.raw
  modified_base (251)..(251): a, c, t, g, unknown or other
  modified_base (262)..(262): a, c, t, g, unknown or other
  modified_base (377)..(377): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagtctgggttttcctcgttgcttcttttaagaggtgtccagtgtcaggtgcagctgggtggagtcggtggggagcgtggtccagccgtgggagtcctgagactctcngtgcagcctgngacttcaccttcagtagctaagtcggactagtcgccgtacgtcgggtccccgcgaggccctaccggaggccggaaggggctggggaggtggggcgtactaggttcaatctaagtntggtagtagggtaacctttaataaacgttccgtagtcgaccgggtaacctcgtagggaaccggtcctaagttcccaacctatccctacgaagtaaacgtaaccaaacttacccgaaaagaacccgagttacctaggtttaaacacgtacgaacgtaagaacgtaaccgaaacgacgacgtaggaaacgtacggtacgggacgggtactacgtagttacgtacttacgtacgtaggaacgtaaacgtaaagtagtacggtaggtaacgtaggtaacgg

SEQ ID NO: 439978 - DNA, 669 bp, Homo sapiens
  misc_feature: GZ8MTXP02H5Y9A.21.77.G11.1.454.CMB.2.raw
  modified_base (260)..(260): a, c, t, g, unknown or other
  modified_base (282)..(282): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctntgacttcacttcagtagctagnggcatgcacgtcgggtcccgcgaggcctacggaggacggaaggggctaggggaggtggggtacgcgtaggttctactctatacgtaggagttagggtaactttataacttcctagtacggccgtacgtccggttagggaaccgggtacctacgttccaaccgtactaccttaccgaacggtaacgtaaaccctaaaaccgtttaccgaaaacgtaaccgtaacccggttctaacgtttactcccgtttaagaaacgtagttaacgaacgtaacggtaccgtaggacggtacggtacgggtacggggaaaccgaccggtcttacggttacttaacgttacgtaggtaccgaagtaaacgaggtaggtagggtagtacggttaggaacg

SEQ ID NO: 439979 - DNA, 618 bp, Homo sapiens
  misc_feature: GZ8MTXP02ISWSM.21.77.G11.1.454.CMB.2.raw
  modified_base (255)..(255): a, c, t, g, unknown or other
  modified_base (263)..(263): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggacgtccctgagactctcctgtncagccctntggacttcaccttcagtagctagtggcatcgcacgtgggtccgccaggcctccgaggcgaagggggctgggaggtggggtgctaggttctatcatatgtagtggtaacttataaacttcctagtcgaccggtactccgggtaggaaacggggtccgtattcccgaacctactcccgtacctagaacgaactaaactaccaaacgaacacgtctagtactctagacgagtagtacgaacacgcctagacgacgacggtacgggggaccacggggtacttacggttacttaacgttacgttaggtaacggaacgtaaaggtacgttaggttacggggtacggtaaacggttacgggg

SEQ ID NO: 439980 - DNA, 620 bp, Homo sapiens
  misc_feature: GZ8MTXP02H7AJ6.21.77.G11.1.454.CMB.2.raw
  modified_base (359)..(359): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccaggccgtgggagtccctgagactctctgtgcagcctgtggattccaccttcagtgctatcggcatgccagtcgggtcccgcaggcctaccgaggacggaaggggctgggaggtgggcgcgtagttcagtcatagngattaggtaactttataaacttcctaagtcggaccgtacgtcggtagaaccggtctataccgactactccacgtagacaactaactacaaacgaacaccgtactagttactcgtacgacgagaatacgaacagtaccgtaggaacggtacggacggtacggggaccgtacggtacgttacggttacgttaacgtttaccgtaggtaacggtaacggtaaaacgttacggttaggttacgggggtaagtaacgggtacgggg

SEQ ID NO: 439981 - DNA, 538 bp, Homo sapiens
  misc_feature: GZ8MTXP02FM8SC.21.77.G11.1.454.CMB.2.raw
  modified_base (359)..(359): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcgtggtttccgtcgttagctctttaagaggtgtccagtgtcaggtgcagctggtggagtcgtgggggagcgtggtccagcctgggaggtccctgagactctcctgtgcagcctctggattcaccttcagtagctatggcatgcactgggtccgccaggctccgaggcaaggggctggaggtgggtgcagttctatcatatgatgggactttanaaatcctaatcgcggactccggtaggagggccgattcaccatcctccagagaacaattaccaaagaaacacgctgtatctgccagatagaaacacgccgtagagaaggcgtacgggggacaacgggcttcgtaccttaattacgtgtaagacgaaaagagtagtgggtagacgtagggg

SEQ ID NO: 439982 - DNA, 798 bp, Homo sapiens
  misc_feature: GZ8MTXP02IQZ4I.21.77.G11.1.454.CMB.2.raw
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggagtccctgagactctcctgtgcagcctctggacttcaccttcagtagctagtcggcatgctacgtcgggtcccgccgtaggcctacccggagggccgaaacgggggtcctggggaacggttcgggggtacgggccgttaacggtttacctaagtctaagttagtaggaagtttacggggtaaaccgtttaataaaacgttcccgttaaaggttcggaccgggttaaccgttacccgggtagggtaaaaccgggggtcccgttaaactttacccgaaacccgtaacttcccgttaacccgaaacggtaaacgtaaacccgttaaaaccgttaacccaaaacgtaaacccgaaccggttacttacggttaacttccgttacggaaccgtaacgtaagtaacggaaaccgtacggacccgttaagggaacggaacggtaccgggttacgggggaacccgtaaccggggtcgtttacggttaccgtttaaacgttcccgtttagggtaacggtaaaccgggtaaaaggttacggttaaggttacgggggttacgtagggtttaacggggg

SEQ ID NO: 439983 - DNA, 592 bp, Homo sapiens
  misc_feature: GZ8MTXP02H4JGH.21.77.G11.1.454.CMB.2.raw
  modified_base (288)..(288): a, c, t, g, unknown or other
  modified_base (307)..(307): a, c, t, g, unknown or other
  modified_base (412)..(412): a, c, t, g, unknown or other
  modified_base (415)..(415): a, c, t, g, unknown or other
  modified_base (418)..(418): a, c, t, g, unknown or other
  modified_base (420)..(420): a, c, t, g, unknown or other
  modified_base (433)..(433): a, c, t, g, unknown or other
  modified_base (436)..(436): a, c, t, g, unknown or other
  modified_base (441)..(441): a, c, t, g, unknown or other
  modified_base (447)..(447): a, c, t, g, unknown or other
tcagtcgtcgctcgcacgaccggtgctcgatttagctagtcactcaagggaaaggggggagaggagcccagcactagaagtcggcggtgtttccattcggtgatttcagcactgaacacagaggactcaccatggagtttgggctgagctgggttttcctcgttgctcttttaagaggtgtccagtgtcaggtgcagctggtggagtcgtgggggaggcgtggtccaggcctgggaggtccctgagactctcctgtgcagcctcgtggacttcaccttcagtagctanggcatgcacgtcgggtccnccaggcctaccgaggccgaaggggtctagggaggtggggtcgctagttcaatcagttatgagtaggaacttataaactctagtcgcgactcgagacgcgatcacntcncananacactacaagacncanagtancgtganaagatacgaaacacgacctagaacgtaacggtcgggacggggaccgacggtaccggttacgttacgttaacgtttacgtaggttaacggaaacggtaaaaaggttacgttaacggggttacggggtaacggtaaggtaacggggg

SEQ ID NO: 439984 - DNA, 680 bp, Homo sapiens
  misc_feature: GZ8MTXP02HORB5.21.77.G11.1.454.CMB.2.raw
  modified_base (279)..(279): a, c, t, g, unknown or other
  modified_base (290)..(290): a, c, t, g, unknown or other
  modified_base (300)..(300): a, c, t, g, unknown or other
  modified_base (311)..(311): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgacgtactctccgtgtgcagcctgtggattccaccttnagtacgctagnggcatcgacncgtcgggcccncgaggcctaccggaggcgaaggggctaggggaggtgggtcgctaggttctagtccgtaattgtaggtacgtagggtaactttaataaacttcctaagtccggtaccggtactacgggtacggtaaacgggtcctaacttcccaaccgtacttacccgtaccgaagtaacgtaaactaaaccgttaaccgaaagaaaccaccgtacttaggttaactccgtagaaacaggtaactacgaaacgcgtaccgtaggaaggcggtacggtacgggggaacctaccgggttacgttacgttaacgtttacgttacgtacggtaacgtaaacggtaaaagtacggttaagggtcgggtaacggtaacggtacggg

SEQ ID NO: 439985 - DNA, 514 bp, Homo sapiens
  misc_feature: GZ8MTXP02GIBCU.21.77.G11.1.454.CMB.2.raw
  modified_base (259)..(259): a, c, t, g, unknown or other
  modified_base (298)..(298): a, c, t, g, unknown or other
  modified_base (344)..(344): a, c, t, g, unknown or other
  modified_base (354)..(354): a, c, t, g, unknown or other
  modified_base (457)..(457): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggagtccctgagactctctgtgcagcctntggattcaccttcagtgctatggcatgcacgtgggtccnccaggctccgaggcaaggggctgggagtgggtgcagttcatcatangatggattanaaatctatgcgactcgagacggcatcacatcacagacgacaataccaaagaacaccgctagtatctgacagactagaacgacgctagagagcgtaggggaacncgggtatcgtactacgttacgtggtaagacgaaagtataggtaggtagacggtaggg

SEQ ID NO: 439986 - DNA, 596 bp, Homo sapiens
  misc_feature: GZ8MTXP02GYYRM.21.77.G11.1.454.CMB.2.raw
  modified_base (473)..(473): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccaggcctggggacgtccctgacgtactctcctgtcgcagccctctggacttccaccttcagtacgctagtggacatcgctacgtcggtacccgcctaggcctcgaggcgaaggggctagggaggtggggtgcctaggttctacgtcatagtgatggaacgtttataactctagtggaccgtactccgggtaggaacggtccgtattacacatcctacaagacgactaataccaaagaacacgactacgtancgtagaccagactagaacgtacgaccaggagacggacggaggggaccaacggtccgtagttacctaagttacgtacgaacgtaacgtaaaacgtagtaacggtagggttacgaggtaacgggg

SEQ ID NO: 439987 - DNA, 776 bp, Homo sapiens
  misc_feature: GZ8MTXP02GQRQL.21.77.G11.1.454.CMB.2.raw
  modified_base (263)..(263): a, c, t, g, unknown or other
  modified_base (268)..(268): a, c, t, g, unknown or other
  modified_base (282)..(282): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcggtgggggaggcgtggtccaggccgtggggacgtccctgagctctcctgtgcngcctntgacttccaccttnagtagctagtggactatcgccgtacgttccggggtccccgaccgacggtccctcccggaagggtacccggaaaggggggtctaggggaggggtttgggggtacgtacgtaacggtttactaagttcctaagttagtggtaaagtttacggggtaaactttttaactaaaaccgtttcccgtaaaggttcgggtaaccccgggtaaacggtttcccgggtaaacgggaaaccgggggtccccgttaactttaccccgaaaccgttacgttacccgtaacccgaaggtaaaccgtaaaaccctaaacgttaacccgaaaaagtaaacccgtaaccgtaccgttaaggttaactcgtacggacctaaagtaacgtaacggaaacgcggtaccgaaggacgtacggtacgggtacggggaaacgtcggtcgtacgtttacgtaacttacggtagtaacggaaacgtaaacgttagtaaggttggggtatacgggtagg

SEQ ID NO: 439988 - DNA, 562 bp, Homo sapiens
  misc_feature: GZ8MTXP02H6IWJ.21.77.G11.1.454.CMB.2.raw
  modified_base (497)..(497): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagccgtgggagtcctgagctctcctgtgcagcctgtggattccaccttcagtagctatggcatgccacgtgggtcccgccaggccctaccgagggcgaaggggctggggaggtgggtcggctagttcatcatatgatggaacttataaacttccagtcgccggactccggtagacggcacttcactatctacagacgacaataccaagaaacacgtctagtactctagcaagagtacgaacacgtccgtagagacggtacggtcggggaaacncgggtactacgttacttacgttacgtggtaacgacggtaaaagtacgtagtggggtagagtaggg

SEQ ID NO: 439989 - DNA, 616 bp, Homo sapiens
  misc_feature: GZ8MTXP02F6OOD.21.77.G11.1.454.CMB.2.raw
  modified_base (260)..(260): a, c, t, g, unknown or other
  modified_base (281)..(281): a, c, t, g, unknown or other
  modified_base (298)..(298): a, c, t, g, unknown or other
  modified_base (360)..(360): a, c, t, g, unknown or other
  modified_base (416)..(416): a, c, t, g, unknown or other
  modified_base (436)..(436): a, c, t, g, unknown or other
  modified_base (438)..(438): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcagctggtggagtcgtgggggagcgtggtccagccgtgggagtccctgagctctctgtgcagcctntggattcaccttcagtgctanggcatgcacgtgggccncaggctaccgaggcgaaggggctgggagtgggtgctagttcatcatatgagtaggactttanaaacttccgtaatcggaccgtactccggtaggaacgggctactcaccatctacganacgaactactacaaagaacncnctatactcgtgacaagacgtacgaacgacgccgtaaggacggacggtcgggttacgggggaacctaccggggttacttacggttaccgtttaaacgttaccgggttaggtaaccgggaaaaccggtaaaaggttacggttaacgggtttagggggtaacgtaacgggtttaacggggg

SEQ ID NO: 439990 - DNA, 666 bp, Homo sapiens
  misc_feature: GZ8MTXP02IHK7I.21.77.G11.1.454.CMB.2.raw
  modified_base (310)..(310): a, c, t, g, unknown or other
  modified_base (378)..(378): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctgggtggagtcgtgggggagcgtggtccagccgtgggacgtcctgagactctcctgtgcagcctgtgattcaccttgagtagctagtcggacagtggccacggtcggggtcccnccgaggccctaccgaggtacgaaaggggtctgggacgggtgggtaggcctaggttcactacagttacnggtaattcgggaactttagtaaacttccgtaaagtccggaccggtactccgggtaggaaacggggtccacttaccgaactacgtacctacgaaggtacaactaactaccgaaacgtaaaccacggtacctagttactccacgtacgaacgtagacgaacgacggtaccgtaggaaacggcgtacgggtacggggacctacgggtaccttacggttacttacgttaccggttaggaacggtaaaccgtaaaaggtacggttaacggtgggggtacgtaaacggtcgggg

SEQ ID NO: 439991 - DNA, 679 bp, Homo sapiens
  misc_feature: GZ8MTXP02FU954.21.77.G11.1.454.CMB.2.raw
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctgggtggagtcgtgggggagcgtggtccagccgtgggacggtccccgagacccctctgtcgccagcctcgtggacttccaccttcagtagctagtgactatcgccacgtcgggtccccgcacgggcctaccggagggaccgaaggggccgtagggaggttggggtggctagttctagtctaagttatggtagttacggtaacgtttaaactaaacttcctaagtcggaccggtacctccgggtaagggaaccgggtccgtaattacccgaccctataccgtaccgaaggaacaacctaacgttaacccgaaacggtaaccaacgtacgttacgttactccgtagacgagtaagtacgaaacgtacgccgtaaggacgacggacggtacggggacaccgggtactaggttactacgtttaacgtaggacgtaaacggaaagtaggttaaggtaggggtacgtaggtacggacgttaaccgg

SEQ ID NO: 439992 - DNA, 931 bp, Homo sapiens
  misc_feature: GZ8MTXP02FX7XK.21.77.G11.1.454.CMB.2.raw
  modified_base (193)..(193): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtncagctggtggagtcgtgggggaggcggtggtccgtcgaccgtcgggtagggtccgtcgaggacgtcctcctcgtggtccacgtccgtccttcggtagttaccctaccccttaccttacgtaaaggttcgtaacgttacgggtcggaacttcgccgtaaccgttcgggggttcccggggccccaacccggggtccgttaccccgtaacggggaccggggaaacggggggtacccggggttgggacggggggtttaggggtcggggggttacgaaccgggtttttacttaaccgttacctaagttaaacgtttacgggtaaaggttaaacggggttaccgggttttaaaaccgtttaaaaataacccgttttaccggttaaggggtaccccggggtaaaccggtttaccccgggggttacgggtaaaaacggggggaccccggggttaaacctttaccggtaaacccctaaaccggttaccctttacccgaaacggtaaacgtaaacccgtaaaacttaaccccgaaacggaaacccgtacgtaaccggttcttaagtttccgttacggaccgaagttaaggtaaccggtactaaacggccgttagggtacgggaaggcccgggttagggggtaaacccggaccgttccgttagttaccgtttaagttacgtttacggggaaggtaaacccggtaaaagtaaggttcgggtttaaggggtacggggtaggttaacggggg

SEQ ID NO: 439993 - DNA, 660 bp, Homo sapiens
  misc_feature: GZ8MTXP02HMHMY.21.77.G11.1.454.CMB.2.raw
  modified_base (253)..(253): a, c, t, g, unknown or other
  modified_base (256)..(256): a, c, t, g, unknown or other
  modified_base (305)..(305): a, c, t, g, unknown or other
tcagtcgtcgctcgcacgaccggtgctcgatttagctagtcactcaagggaaaggggggagaggagcccagcactagaagtcggcggtgtttccattctgtgatcagcactgaacacagaggactcaccatggagtttgggctgagctgggttttcctcgttgctcttttaagaggtgtccagtgtcaggtgcagctggtggagtcgtgggggagcgtggtccagccgtgggacgtccctgagactctcctgngcngcctctggattccaccttcagtagctatggacatgcacgtcggggtccnccaggcctccgaggcgaaggggctggagtggggtgctagttccctagtcatatgagtggtacgtttaataaatcctagtcggacggtactccggtaggaacgggtcccgtattcccgacctacgtcctaccgagaacgtaacaaacttaccgaaaagaaaccacgtaccgtttagtaactcgtacgaccaaagtacgtaacggaaaccgacgacccgttagggaaaaccggtggtaccggggtacgggggaaaccctacgggggttcccttacgggtttacttaacggtttaaccgtggggtttaacgaccgggtaaaaagtacgtttaaagggtcgggggttagtaaccggggg

SEQ ID NO: 439994 - DNA, 725 bp, Homo sapiens
  misc_feature: GZ8MTXP02IYTEV.21.77.G11.1.454.CMB.2.raw
  modified_base (278)..(278): a, c, t, g, unknown or other
tcagtcgtcgctcgcacgaccggtgctcgatttagctagtcactcaagggaaaggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggagcgtggtccaggccgtgggacgtccctgacgactctcctgtgcagcctcgtggattcacttnagtagctagtggactagtcgactacggtcgggtcccgaccgtacggcctacccggagggaccggtaaagggggtccctaggggtacgggttcgggggtacgtccgtaaggttttccaagttcctaagttagtaggtaacggttacgggtaacgtttaactaaacgttccttaaagtccgggtaccggtaccgttccgggtaaagggtaaaccggggtccgttaacgttacccgaacctacgttacccgtaccgaacggaaacgtaaacctaaacgttaaccgaaaacggtaaaccaccgtacgtacgtactcgtacgaacgtaacgaacgtacgaaacgacgaccgtagacggtacggtacggtacggggacctacgggtcttacgttacgtacgttacgtaggtaacgaaacgtaaagtacgttaggcgggtaagtacggtacggg

SEQ ID NO: 439995 - DNA, 688 bp, Homo sapiens
  misc_feature: GZ8MTXP02HBCWK.21.77.G11.1.454.CMB.2.raw
  modified_base (290)..(290): a, c, t, g, unknown or other
  modified_base (320)..(320): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcagctggtggagtcgtgggggaggcgtggtccaggcctgggagtccctgacgactctcctgtgcagtcctgtgacttcgaccttcagtagctagnggcatcgcacgtcgggtccgccacggtccnccgaggacgaacggggctgggagggtgggtgctagttcatactagtactgagtacggtaacgttattaaacttcgtaaagttcgggaccgtaaccggtacgggtacgggtaaacgggggtcccttaaacgtacccaacctacgtcccgttaaaccgacgtaaacgtaaacctttaaaaccacccgaaaacgaacccgtagtaccgtttatacgttacctagaccgtaacgagttaaccgaaacgcgtaccgacggaaaggacggtcgggtaacgggtaccgaacggttcgtacggtttacgttaacgttaccggttagaaaggtaacggaaaggttagttagggttaccgggaggtaaaggtaccggg

SEQ ID NO: 439996 - DNA, 628 bp, Homo sapiens
  misc_feature: GZ8MTXP02FFSKB.21.77.G11.1.454.CMB.2.raw
  modified_base (242)..(242): a, c, t, g, unknown or other
  modified_base (257)..(257): a, c, t, g, unknown or other
  modified_base (264)..(264): a, c, t, g, unknown or other
  modified_base (268)..(268): a, c, t, g, unknown or other
  modified_base (277)..(277): a, c, t, g, unknown or other
  modified_base (306)..(306): a, c, t, g, unknown or other
  modified_base (388)..(388): a, c, t, g, unknown or other
  modified_base (524)..(524): a, c, t, g, unknown or other
  modified_base (619)..(619): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagcttgggttttcctgttgcttcttttaagaggtgtccagtgtcaggtgcagctgggtgagtcgtgggggagcgtggtccagccgtgggacgtcccngagtactctcctgtncagcctntggnttcaccttnagtgctatcggacatcgacacgtgggccncaggctcgacggcgaaggggctagggaggtggggtgcgtacgtttacacgtacaatataggtacgtacggttaacgttttanaaaaccgttccgtaaagttccgggacgttaccgtacggggtaacgaaacggggtcccgtaattccgaacctactacccgtacaaggtaacaaccgtacttaaccgaaacgaaacacgtcgtacgtaatcctagganaacgattacgaacgtacgacgaggacgaggacggtacgggacgacgtccgagttacttagtactaggcgaaacgaaagtagtacggtgggtacgnggtaaacgg

SEQ ID NO: 439997 - DNA, 511 bp, Homo sapiens
  misc_feature: GZ8MTXP02JAJ4E.21.77.G11.1.454.CMB.2.raw
  modified_base (273)..(273): a, c, t, g, unknown or other
  modified_base (396)..(396): a, c, t, g, unknown or other
  modified_base (401)..(401): a, c, t, g, unknown or other
  modified_base (424)..(424): a, c, t, g, unknown or other
  modified_base (427)..(427): a, c, t, g, unknown or other
  modified_base (429)..(429): a, c, t, g, unknown or other
  modified_base (431)..(431): a, c, t, g, unknown or other
  modified_base (433)..(433): a, c, t, g, unknown or other
  modified_base (435)..(435): a, c, t, g, unknown or other
tcagtcgtcgctcgcacgaccggtgctcgatttagctagtcactcaagggaaagggggggagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggagtccctgagactctcctgtgcagcctctggattcaccttnagtagctatggcatgcacgtggtccgcaggctccgaggcaaggggctggagtgggtgctaggttctatcatatgatggacttataaatcctatgacgtactcgtagaagggccatcaccatcncaganacaatcaagaacacgctgtatcnganananananagacagagagacgaggacgacgacgtcgtactacttacgtagtaagtacgaaacgaagtagtaggtacgtagtagg

SEQ ID NO: 439998 - DNA, 543 bp, Homo sapiens
  misc_feature: GZ8MTXP01DQOB0.21.75.G09.1.454.CMB.2.raw
  modified_base (270)..(270): a, c, t, g, unknown or other
  modified_base (342)..(342): a, c, t, g, unknown or other
  modified_base (346)..(346): a, c, t, g, unknown or other
  modified_base (371)..(371): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggtttccttgttgctactttaaaggtgtccaatgtgaggtgcagctggtggagtctggggggagatttggtacagccaggggcggtccctgagactctcctgtacaacctctggattcacctttggngattatgctatgagctggttccgccaggctccagggaaggggctggagtgggttgtttcgcagaagcaaagnttanggtgaacaccccagattacgcccgngtctgtgaaagacagattcacaaatctcaagagatgattacaaaagcaatcgcctatctgacaaagtagaacagacctgaacgacgaggaacacagccgtgtataactgttactcgacgacctccgttattagttcggcctagtctttgacttacgtcgggccgtaaccggg

SEQ ID NO: 439999 - DNA, 585 bp, Homo sapiens
  misc_feature: GZ8MTXP01EXJML.21.75.G09.1.454.CMB.2.raw
  modified_base (345)..(345): a, c, t, g, unknown or other
  modified_base (350)..(350): a, c, t, g, unknown or other
  modified_base (408)..(408): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagtatttggtacagccagggcggtccctgagactctcctgtacaacctctggattcacctttggtgattatgctatgagctggtcccgcaggctccgaggggagggctggagtgggttggttcgtcagaagcaaagtnttagnggtagaacacccagattaccgccgcgtctagtgaaagacagtattacaacaatcctanaaagagatagacttaccaaaagcaatcgacctatctagacaaagtgaaacagcctagaaacgaccgaggaaccacgcgtccgtagtaattaacttgttacctacgacgtaccctccgttaagttacgttcgggtaacctgtcgtttgaccgttaggtccggggaaccgtaaccgggg

SEQ ID NO: 440000 - DNA, 569 bp, Homo sapiens
  misc_feature: GZ8MTXP01CLHLX.21.75.G09.1.454.CMB.2.raw
  modified_base (271)..(271): a, c, t, g, unknown or other
  modified_base (282)..(282): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccagggcggtccctgagactctcctgtacaacctctggattcacctttggngattatgctangagctggttccgccaggctccgaggggagggctggagtggggttggttcgtcagaagcaaagattagtggtaggaacacccgagattacgccgcgtctgtgaaagacagattcaacaatctacaagagatgaattaccaaaagcatcgcctatctgacaaagtgaaacagacctagaacgaccgaggacacgacgccgtgtattaactgttactcgacgtacccttcccgttaattacgttcgggaaccctgtcgtttgaccgttacggtcggggaaccgaacgggg

SEQ ID NO: 440001 - DNA, 569 bp, Homo sapiens
  misc_feature: GZ8MTXP01DZKNL.21.75.G09.1.454.CMB.2.raw
  modified_base (275)..(275): a, c, t, g, unknown or other
  modified_base (388)..(388): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggagtatttggtacagccaggggcggtccctgagactctcctgtacaacctctggattcacctttggngattatgctatgagctggttccgccaggctccgagggaaggggctggagtggggttggtttcgtcaggaagcaaaggatttagtggtaggaaactaccccagattacgcccgngtctgtggaaagacagattcaactaatctacaagagatagattaccaaaagcaatcgcctatctagacaaatgaacagcctagaagaccgaggaacacgagccgtgtattaactgttactcgacgaccctcccgttattacgttgggaacctgtctttgacttacgtcgggccgtaacggg

SEQ ID NO: 440002 - DNA, 562 bp, Homo sapiens
  misc_feature: GZ8MTXP01A1DBS.21.75.G09.1.454.CMB.2.raw
  modified_base (329)..(329): a, c, t, g, unknown or other
tcagtcgtcgctcgcacgaccggtgctcgatttagtatagacatcaggggggagaggagccccagccgtgagattcccaggagtttccacttggtgatcagtactgaacacagaccaccaaccatggagtttgggcttagctgggttttccttgttgctactttaaaggtgtccaatgtgaggtgcagctggtggagtcgtgggggagatttggtacagccagggcggtccctgagactctcctgtacacctctggattcacctttggtgattatgctatgagctggttccgcaggctccgagggagggctgggagtggggttgttcgnagagacaaagattagtggtagaacacgagtacttacgccgcgtctagtagaagacagtattcaactaatctacaaagagatagattaccaaaagcatcgcctatctgacaaatggaacagcctagaagaccgagacacgcgtccgtagtattctaagtacttcgacgacctaccgtaattaacgttcgggaccctggtcttcgactacggttgggaaccgaacgggtaacccg

SEQ ID NO: 440003 - DNA, 557 bp, Homo sapiens
  misc_feature: GZ8MTXP01AEUAK.21.75.G09.1.454.CMB.2.raw
  modified_base (209)..(209): a, c, t, g, unknown or other
  modified_base (270)..(270): a, c, t, g, unknown or other
  modified_base (277)..(277): a, c, t, g, unknown or other
  modified_base (293)..(293): a, c, t, g, unknown or other
  modified_base (341)..(341): a, c, t, g, unknown or other
  modified_base (374)..(374): a, c, t, g, unknown or other
  modified_base (394)..(394): a, c, t, g, unknown or other
  modified_base (401)..(401): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggganatttggtacagccagggcggtcctgagactctcctgtacaacctctggattcacctttggngtattangctatgagctggtccnccaggctcgagggagggctggagtgggttgttcgtcaggaagcaaagnttagtgggtagaacaccccagtacttacgccgngtctgtgaaagcagattcanaatctanaagagatgaattaccaaagcatcgacctatcagacaatagacagacgagagacgacgacacagcgtcgtattaactcgttactcgacgtaccgtaccgttacgttacgttcggtaaccgtcgtcgttcgtacgttacgtcgggccgtaacccgggg

SEQ ID NO: 440004 - DNA, 644 bp, Homo sapiens
  misc_feature: GZ8MTXP01CWICH.21.75.G09.1.454.CMB.2.raw
  modified_base (307)..(307): a, c, t, g, unknown or other
  modified_base (348)..(348): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagttgggcttagcttgggttttccttgttgctactttaaaaggtgtccaatgtgaggtgcagctgggtggagtcgtgggggggagtagttttgggtacaggccgaggggccggtccctgagactctcctgtacaacctctggattcacctttggtgtattatgctatgagcgtggtccncgaggctcgaggggagggctggtaggtggggtttgtttcgnaggaagacaaagtattagtggtaggaaacctaccccgagtacgttaccgcccgtcgttaactaggtaagaaaagacaagtacttacaaactaatctacaaagagtaatagaacttaccaaaagtcaatccgaccttatctagacaaaagtacgaaacacgacctaggaaacgaccgagaaccacgacgtccgtagttattaacgtcgttactcgaacgtacccttaccgttaagttacggttcgggtaacccttgtcgttttacgacgttacggtccgggggcccgtaaccggggg

SEQ ID NO: 440005 - DNA, 573 bp, Homo sapiens
  misc_feature: GZ8MTXP01AC9VR.21.75.G09.1.454.CMB.2.raw
  modified_base (283)..(283): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtctggggggagatttggtacagccagggcggtccctgagactctcctgtacaacctctggattcacctttggtgattatgctangagctggttcccgccaggctccgaggggaaggggctgggagttgggggttggtttcgtcgagaagcaaagattagtgggtggaaacacccagattaccgcccgcgtctgtgaaagacagtattcaacaaatctacaaagagatagattaccaaaagcatcgactatctagacaaagtgaaacagacctaggaacgaccgaggaacacagtccgtatattaactgttactcgagaccctaccgttattagttcgggaacctgtctttgacttacgtcggggccgtaacggg

SEQ ID NO: 440006 - DNA, 581 bp, Homo sapiens
  misc_feature: GZ8MTXP01BLCKS.21.75.G09.1.454.CMB.2.raw
  modified_base (269)..(269): a, c, t, g, unknown or other
  modified_base (280)..(280): a, c, t, g, unknown or other
  modified_base (291)..(291): a, c, t, g, unknown or other
  modified_base (345)..(345): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctacttaaaggtgtccaatgtgaggtgcagctgggtggagtctgggggagatttggtacagccagggcggtccctgagactctcctgtacaacctctggattcacctttggngattatgctangagctggtccncaggctcgagggaagggctggagtgggttggtttcgtcagaagcaaagattagnggtgaacaccagattacgccgcgtctagtgaaagacagtacttcaacaaatctacaagagatagtaattacccaaaagcaagtccgacctatctagacaaatacgaaacacgacctagaacgaccgaaggaacacgacgccgtagtattaactcgttactcgacgtaccctcccgttaagttacgcgggtaaccctgtcctttagaccgttacggtcggggaaccgtaacccgggg

SEQ ID NO: 440007 - DNA, 586 bp, Homo sapiens
  misc_feature: GZ8MTXP01AXVK3.21.75.G09.1.454.CMB.2.raw
  modified_base (208)..(208): a, c, t, g, unknown or other
  modified_base (269)..(269): a, c, t, g, unknown or other
  modified_base (274)..(274): a, c, t, g, unknown or other
  modified_base (279)..(279): a, c, t, g, unknown or other
  modified_base (290)..(290): a, c, t, g, unknown or other
  modified_base (322)..(322): a, c, t, g, unknown or other
  modified_base (326)..(326): a, c, t, g, unknown or other
  modified_base (332)..(332): a, c, t, g, unknown or other
  modified_base (337)..(337): a, c, t, g, unknown or other
  modified_base (401)..(401): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctggggganatttggacagccagggcggtccctgagactctcctgtacaacctctggattcacctttggnattangctangagctggtccncaggctcgagggaggctggagtggttgttcgnagancaaagnttagnggtagaacacccgagattacgccgtcgtactggtaagaaagcaagtattacaactaaattccanaaagagatagaacttaaccaaaagctaatccgacctaatctagacaaatcgaaacacgacctaggaaacgacccgaaggtaaccacgacggtccgttataacttaacgtcgttactacgacgtacccttccgttaagttacgttcgggaacctgtccttagacttacggtgggcccgtaaccggg

SEQ ID NO: 440008 - DNA, 563 bp, Homo sapiens
  misc_feature: GZ8MTXP01A4WSB.21.75.G09.1.454.CMB.2.raw
  modified_base (348)..(348): a, c, t, g, unknown or other
  modified_base (352)..(352): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctgggggagatttggtacagccagggcggtccctgagactctcctgtacaacctctggattcacctttggtgattatgctatgagctggttccgccaggctccgaggggaaggggctggagttggggttgtttcgtcagaagcaaagnttanggtaggaacaccccgagattacgccgtcgtctgtgaaagacagattcaacaatctacaagagatgaattaccaaaagcatcgccttatctagacaaagtgaacagcctagaacgaccgaggacacgagccgtgtattaactgttactcgacgacccgtcccgttagttaattcgggaacctgtcttgacttacgtcggggcccgaacgggg

SEQ ID NO: 440009 - DNA, 605 bp, Homo sapiens
  misc_feature: GZ8MTXP01AHGDA.21.75.G09.1.454.CMB.2.raw
  modified_base (256)..(256): a, c, t, g, unknown or other
  modified_base (271)..(271): a, c, t, g, unknown or other
  modified_base (283)..(283): a, c, t, g, unknown or other
  modified_base (294)..(294): a, c, t, g, unknown or other
  modified_base (339)..(339): a, c, t, g, unknown or other
  modified_base (344)..(344): a, c, t, g, unknown or other
  modified_base (408)..(408): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgcttactttaaaaggtgtccaatgtgaggtgcagctggtggagtcgtgggggatatttggacagccagggccggtccctgagactctcctgtacacctntggattcactttggngtattatgctangagctggtccncaggctcgagggagggctggagtgggttgttcgcagaagcaaagnttagnggtaggaaccaccgagtattaccgccgtgtactgtaagaaagacagtacttcaacaaatcctanaaagagatagaacttaaccgaaaagcaatcgaccttatcctagaacaaagtacgaacacgaccgtagaaacgaccggaaggaaccacgtacgtccgttagtacttaacgtcgttactcggaacgtacccgttaccgttagttacggttcggggtaacctggtcgttcgacgttacggtcggggaacccgtaacgggg

SEQ ID NO: 440010 - DNA, 640 bp, Homo sapiens
  misc_feature: GZ8MTXP01A1AIG.21.75.G09.1.454.CMB.2.raw
  modified_base (268)..(268): a, c, t, g, unknown or other
  modified_base (274)..(274): a, c, t, g, unknown or other
  modified_base (279)..(279): a, c, t, g, unknown or other
  modified_base (291)..(291): a, c, t, g, unknown or other
  modified_base (348)..(348): a, c, t, g, unknown or other
  modified_base (353)..(353): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagtatttggtacagccagggccgtcctgagactctcctgtacacctctgattcactttggngattangctangagctggttccnccgaggcctccgaggggaaggggctgggagttggggtttgttcgcgagaagcaaagnttagnggtagaaccaccccgagtacttaccgcccgtcgttctaggtgaaaagacaggtactttacaactaaattcctacaaagagtaagtacgtaacttaaccaaaaacgctaactccgtacccttaatcgtacgaaccaaagtacgaaacgagtacccgtaggaaacgaccgaaggaaccacgtacgtccgtagttattaacgtcgttactcgacgtacccgtacccgttaagttacgttcgggtaaccttggtcgttttcgaccgttacggtcggggcccgtaaccgggg

SEQ ID NO: 440011 - DNA, 628 bp, Homo sapiens
  misc_feature: GZ8MTXP01A767L.21.75.G09.1.454.CMB.2.raw
  modified_base (276)..(276): a, c, t, g, unknown or other
  modified_base (287)..(287): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagatttggtacagccgaggggccggtccctgagactctcctgtacaacctctggattcacctttggngattatgctangagctggttccgccaggcctccgaggggaaggggctgggaggttggggtttggtttcgtcgaaggaagacaaaaggtatttagtgggtaggaaaccaccccgaggtacttaccggcccgtcgtactggtaagaaaagacagtacttcaacaatcctacaaagagatagaacttaccaaaagcatccgacctatctagacaaagtgaaacagacctagaacgaccggagaaccacgacgtccgtagtacttaacgtcgttacgtacgacgtaccctaccgttaagttacgttacgggtaaccctgtccgtttgaccgttacggtcggggccgtaacccgggg

SEQ ID NO: 440012 - DNA, 547 bp, Homo sapiens
  misc_feature: GZ8MTXP01AR1E1.21.75.G09.1.454.CMB.2.raw
  modified_base (284)..(284): a, c, t, g, unknown or other
  modified_base (295)..(295): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagatttggtacagccagggcggtccctgagactctcctgtacaacctctggattcacctttggtgattatgctangagctggtccnccaggctccgagggagggctggagtgggttggtttcgcagaagcaaagtattagtggtaggaacacccgagattaccgccgcgtctgtgaaagacagattcacaatctacaagagatgattacaaaagcatcgcctatctagacaaagtgaacagcctagaacgacgagacacagccgtgtactctgttactcgagtaccctcgttagttacgttcgggaactgtcttgacgttacgtcgggcgtaaccggg

SEQ ID NO: 440013 - DNA, 753 bp, Homo sapiens
  misc_feature: GZ8MTXP01A06GS.21.75.G09.1.454.CMB.2.raw
  modified_base (274)..(274): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagatttggtacagccgaggggccggtccctgagactctcctgtacacctctgattcacctttggngtattatgctatgagctggtccgccaggctccggaggggaggggcgtggaggttggggttggtttcgtcgaaggaagacgaaaggtattagtgggtacggaaaccacccgagtattaccggccggtcgttacgtagggtgaaaagaccaagtactttaccaactaaactcctacgtaaagagtataggaaacttaacccgaaaaaggctaactaccggtacccttaattcctacgaacctaaaaggttacggaaaacccgtacggtaccccgtaagggaaaccggaacccggaaacgggaaacccgaaccgtaccggggtacccggttaagttaacgtttaaccgtacggttaacccgtaccggaacccgtaaccccgtttaccccggttaaagttacggttaccgggggtaacccttcggttaacccgtttcgggtaacccgttaccggggttaacgggggccccgtaaacccggggg

SEQ ID NO: 440014 - DNA, 746 bp, Homo sapiens
  misc_feature: GZ8MTXP01CMY3B.21.75.G09.1.454.CMB.2.raw
  modified_base (280)..(280): a, c, t, g, unknown or other
  modified_base (288)..(288): a, c, t, g, unknown or other
  modified_base (299)..(299): a, c, t, g, unknown or other
  modified_base (596)..(596): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagtatttggtacaggccagggccggtccctgagactctcctgtacacctctggattcactttggtgattangctatagngtcgtcgtccncgcgtccacggaggggacggtcgtggtaggttggggtttcggttcgtacgaaggaacgaaacgtaaagttagttaggtagggtaacgaaaccaaccgaaggtacgtacccggccgtcgttaacgtaggtaagaaacgactaagtactacaataacttccaaagaaggtactagtacgttaaaccaaaacgaaacgtcctacgtccccgtaacttagtaccgtaacgaaactaaaacggggtacgaaaaccgtccggtacccgaaaagggaaaccccgggaccgggaagaaaaccccncggttacccggttacgtttaacgtttaactaacggttacgttacccgtacggttaacccgttaaccccgttagttaaaggttccgggttccgggtaacttcgtttaacgtaccgtacggttccggggtaaccgggaaccgtaaccccggg

SEQ ID NO: 440015 - DNA, 628 bp, Homo sapiens
  misc_feature: GZ8MTXP01ECE2F.21.75.G09.1.454.CMB.2.raw
  modified_base (260)..(260): a, c, t, g, unknown or other
  modified_base (273)..(273): a, c, t, g, unknown or other
  modified_base (281)..(281): a, c, t, g, unknown or other
  modified_base (284)..(284): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttggcttagctgggttttccttgttgctactttaaaggtgtcaatgtgaggtgcagctgggtggagtcgtggggggagtagttttggtacagccgaggggccggtccctgagactctcctgtacacctntgattcactttgntattatgntangagctggtccgcgaggctcgagggaagggctggaggttggggtttggtttcgtcgaaggaagactaaaaggtatttaagtggtacggaaactaccccgaagtagttaccgccgtcgtactagtaagaaagacaagtacttacaacaaattctacaaagagatacgtaattaaccaaaagcatccgaccttactctagaacaaagtacgaaacgtacgacgtaacgaaacgaccgagaacacgtacgcgttagtattaactgttaccgtcgacgtaccctaccgttaagttacgttacgggtaaccctgtctttcgacgttcgtaacggggaacgtaacccgggg

SEQ ID NO: 440016 - DNA, 594 bp, Homo sapiens
  misc_feature: GZ8MTXP01CT0VQ.21.75.G09.1.454.CMB.2.raw
  modified_base (292)..(292): a, c, t, g, unknown or other
  modified_base (352)..(352): a, c, t, g, unknown or other
  modified_base (357)..(357): a, c, t, g, unknown or other
  modified_base (387)..(387): a, c, t, g, unknown or other
  modified_base (408)..(408): a, c, t, g, unknown or other
  modified_base (413)..(413): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggaggtcgtggggggagtagttttggtacaggccgaggggccggtccctgagactctcctgtacaacctctggattcacctttggtgattatgctangagctggtccgcaggctcgaggggagggctggagtgggtttggttcgcagagacaaagtnttagnggtagaacacccagattacgccgcgtctgngaaagcagtatcacaatctanaaganatgattacaaaagcatcgcctatctagaacaaagtgaacacgacctaggaacgaccggaggaacacgtacgtcgtagttattaacgtagttaccgtaccgacgtaaccccgtcccgttaagttacgttcggggtaaccttgtccgtttaggaccgttacggtcggggcccgtaacccgggg

SEQ ID NO: 440017 - DNA, 606 bp, Homo sapiens
  misc_feature: GZ8MTXP01BNSQN.21.75.G09.1.454.CMB.2.raw
  modified_base (209)..(209): a, c, t, g, unknown or other
  modified_base (267)..(267): a, c, t, g, unknown or other
  modified_base (272)..(272): a, c, t, g, unknown or other
  modified_base (288)..(288): a, c, t, g, unknown or other
  modified_base (337)..(337): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggganatttggtacagccgagggcggtcctgagactctcctgtacactctgattcactttggnattangctatgagctggtccncgaggctccgaggggagggctggagtgggttgttcgacagaagcaaagnttagtggtagaacaccccagattaccgccgtcgtactaggtaagaaacgacagtacttcaactaaagtcctacaagagatagaacttaacccaaaagctaatccacctatcctagacaaacgtaaagaacgacgacgacgaacgaaccggacgacgacgtacgtacgtacgtattaacgttacgttacgtacgaccgtacccgtaccgttacgttacgttacggtaacgtcgttcgttacgtacgttacggtccgggccggtaaccggg

SEQ ID NO: 440018 - DNA, 658 bp, Homo sapiens
  misc_feature: GZ8MTXP01BYA8Z.21.75.G09.1.454.CMB.2.raw
  modified_base (288)..(288): a, c, t, g, unknown or other
  modified_base (532)..(532): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtcgtggggggagtatttggtacagccgagggcggtccctgagactctcctgtacacctctggtattctacctttggtgtattatgctanggagcgttggtccgccgaggctaccgagggggaaggggcgtgggaggttgggggtttggtttcgtcgaagaacgacaaagtattagtgggtagaacacccagtacttaccgccgtcgtacgtagtaagaaagacagtacttacaactaagtctacaaagagtagtagtacttaccaaaagctaactccgacttactactagaactaaagtacgaaacacgacgtagaacgaccggaaggaaccncgtacgtccgttagtaattaacgtacgttaccgacgttaaccgtacccgttaacccgttaagttaacggttcgggtaacctcgtaacgtttacgacgttacgggtccggggaaccgtaacccgggg

SEQ ID NO: 440019 - DNA, 673 bp, Homo sapiens
  misc_feature: GZ8MTXP01BTFVM.21.75.G09.1.454.CMB.2.raw
  modified_base (276)..(276): a, c, t, g, unknown or other
  modified_base (288)..(288): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttcctgttgctactttaaaggtgtccaatgtgaggtgcagctgggtggagtcgtggggggatagtttggacagccgaggggccggtccctgagactctcctgtacacctctggtattctacctttggngtattatgctangagctggtccgcgaggctcgaggggagggcgtggaggttggggttggtttcgtcgaaggaagacaaagtattagtggtaggaaaccacccgagtacttaccggcccgtcgttactaggtaagaaaacgacgtagtacttaccaaactaaacgttcctagaaagagtaatacgtaaacttaacccaaaaagtcctaaacgtccgaccttaatctacgaactaaaaggtacgaaacgacgaccgtaaggaaaccgaccggtaaggaaccacgtacggtaccgttagttaacttaacgtacgttacgtacgaacgtacccgtaccgttaagttacgttcgggtaacctgtcgtttcgacgttacgggtccggggaaccgtaaccgggg

SEQ ID NO: 440020 - DNA, 582 bp, Homo sapiens
  misc_feature: GZ8MTXP01D1RK3.21.75.G09.1.454.CMB.2.raw
  modified_base (274)..(274): a, c, t, g, unknown or other
  modified_base (286)..(286): a, c, t, g, unknown or other
  modified_base (289)..(289): a, c, t, g, unknown or other
  modified_base (298)..(298): a, c, t, g, unknown or other
  modified_base (331)..(331): a, c, t, g, unknown or other
  modified_base (337)..(337): a, c, t, g, unknown or other
  modified_base (342)..(342): a, c, t, g, unknown or other
  modified_base (347)..(347): a, c, t, g, unknown or other
  modified_base (370)..(370): a, c, t, g, unknown or other
  modified_base (383)..(383): a, c, t, g, unknown or other
  modified_base (404)..(404): a, c, t, g, unknown or other
tcagtcgtcgctcgcacgaccggtgctcgatttagtatagacatcaggggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggatagtttggtacagccgaggggccgtcctgagactctcctgtacactctggattcactttggngtattatgctangancgtggtccncaggctcgagggaggctggagtgggttgttcgngagagnaaagnttagnggagaacacccagattacgccgngtctagaagaaanacagtactacaacaatcctanaagagatagaattacaaagcagtccacctatctacgacaaagtacgaactagacctagaacgaccgagaacactagccgtagtattaacgtagttaccgtacgacgtacccgtacccgttaagttacgttcgggtaaccctgtctttcgacgttacggtcgggaaccgtaacccgggg

SEQ ID NO: 440021 - DNA, 593 bp, Homo sapiens
  misc_feature: GZ8MTXP01AMMPR.21.75.G09.1.454.CMB.2.raw
  modified_base (269)..(269): a, c, t, g, unknown or other
  modified_base (280)..(280): a, c, t, g, unknown or other
  modified_base (291)..(291): a, c, t, g, unknown or other
  modified_base (339)..(339): a, c, t, g, unknown or other
  modified_base (408)..(408): a, c, t, g, unknown or other
  modified_base (456)..(456): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtcgtgggggagatttggacagccaggggcgtccctgagactctcctgtacactctggattcacctttggngattatgctangagctggtccncaggctccgagggagggctggagtgggttggtttcgcagaagcaaagnttagtggtaggaacacccgagtattaccgccgtcgtactgtgaaagacagtacttcaactaaatcctanaagagatgaattaccaaaagcatccgactatctagacaaagtcgaacncgacctagaacgaccgaggacctaacgacgtaccgtggttaacttaacgtagttaccttacggacgtaccctacccgttagttacgttcgggtaaccttgtcgtttacgacgttcggtaacggggccgtaaccgggg

SEQ ID NO: 440022 - DNA, 623 bp, Homo sapiens
  misc_feature: GZ8MTXP01AH1ED.21.75.G09.1.454.CMB.2.raw
  modified_base (274)..(274): a, c, t, g, unknown or other
  modified_base (285)..(285): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggggagagtttggtacagccgaggggcggtccctgagactctcctgtacacctctggattcacctttggngattatgctangagctggtccgccaggctccgagggaaggggctggaggttgggttggtttcgtcgagaagcaaagtattagtgggtaggaaccacccgagtattaccggcccgcgtcgtaggtaagaaagacagacttacaactaatctacaagagatagattacaaaagcatcgactatctagacaaatgaacacgacccgtaggaacgacgaggaaccacgacgtaccgtgttaacttaactagttaccgttcgaccgtacccgttcccgttaacgttacgttcgggggtaaccctgttaaccgtttcgaccgttacgggtcgggggttaacccgaaacccggggg

SEQ ID NO: 440023 - DNA, 758 bp, Homo sapiens
  misc_feature: GZ8MTXP01AUTY3.21.75.G09.1.454.CMB.2.raw
tcagtcgtcgctcgcacgaccggtgctcgatttagtatagacatcagggggggagaggagccccagccgtgagattcccaggagtttccacttggtgatcagcactgaacacagaccaccaaccatggagttgggcttagctgggtttccttgttgctactttaaaaggtgtccaatgtgaggtgcagctgggtggagtcgtgggggagtagtttggtacagccaggggccggtcctgagactctcctgtacactctgtattctacctttggtgtattatgctatgagcgtcggttccgccgaggcctccggaaggggaacgggggtcgtagggtagggttggggtttcggtttacgtacgaaggaagacgtaaaagtatttaagtagggtacggaaacctaaccccgagtacgtttaacccgcccggtacgttaccttaggtaacggaaaagtaccgaaagtacttaccaaactaaactactacaaagtaagtaatacgtaacttaaacccaaaacgcctaattacccgaccttaactccgttagaaacccgtaaatacgaaacgaccgtaccgtaaacgaaacggaacccgaaggtaaccgaccgaacggttacccgttaggttaactttaaccgtaacgttacccggtaacgttaaccggtaccccttaacccgttaaaggttacgttaccggggttaactcgttaacccgtttaggtacccgttaacggtccggggttaacccggtaaaccggg

SEQ ID NO: 440024 - DNA, 633 bp, Homo sapiens
  misc_feature: GZ8MTXP01CW5H3.21.75.G09.1.454.CMB.2.raw
  modified_base (271)..(271): a, c, t, g, unknown or other
  modified_base (277)..(277): a, c, t, g, unknown or other
  modified_base (282)..(282): a, c, t, g, unknown or other
  modified_base (335)..(335): a, c, t, g, unknown or other
  modified_base (340)..(340): a, c, t, g, unknown or other
  modified_base (344)..(344): a, c, t, g, unknown or other
  modified_base (402)..(402): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctgggggagatttggtacagccagggcggtccctgagactctcctgtacaacctctggattcacctttggngattangctangagctggtccgcaggctcagggaaggggctggagtgggttgtttcgcagaagnaaagnttanggtgaacacccagattacgccgcgtactgtgaaagacaagattcaactaaatcctaanaaagagaatagtaattaaaccaaaagcactacgaccttatactacgaacaaacgtaacgaaacgaacgaccgtaacgaaacgaaccggaacggaaacgaacgtaacgtaccggtacgttaacgttaacgttacgttacgtacgacgtaacccgtacccgttaaacgttaacgttacgggtaaccgtacgtcgttacgtacgttacggtaacggggttaaccggtaaccggg

SEQ ID NO: 440025 - DNA, 676 bp, Homo sapiens
  misc_feature: GZ8MTXP01AKOZ6.21.75.G09.1.454.CMB.2.raw
  modified_base (264)..(264): a, c, t, g, unknown or other
  modified_base (279)..(279): a, c, t, g, unknown or other
  modified_base (286)..(286): a, c, t, g, unknown or other
  modified_base (291)..(291): a, c, t, g, unknown or other
tcagtcgtcgctcgcacgaccggtgctcgatttagtatagacatcaggggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagtagttttggacaggccgaggggccggtccctgagactctcctgtacaacctntggattcactttggngtattangctangagctggtccgcgaggctcgaggggagggctggagttggggttgttcgtcagaagacaaagtattagtggtagaacaccccgagtacttaccgccgtcgtaactaggtaagaaagacagtactcaacaatctacaagagtatagtaacttaaccgaaaaacgctaacgtccgtacctactacgtacgaactaaacgtacgaaacgaccgtaccgtaaacggaaacggaaccggaacggaaaccaacggtaaccggtaccgttagttaacttaacgtacggttaccgtaccggaacgtaccccgttaacccggttaagttaacgttacggggtaaccttgttccgttacggtaccgttacgggtccggggaaccggtaacccgggg

SEQ ID NO: 440026 - DNA, 667 bp, Homo sapiens
  misc_feature: GZ8MTXP01AMKH7.21.75.G09.1.454.CMB.2.raw
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgcttactttaaaaggtgtccaatgtgaggtgcagctggtggagtcgtgggggatatttggtacagccgagggccggtccctgagactctcctgtacaactctggacttcacgtttgtgtattatgctatgacgtcgtcggttccgccgaggcctaccggagggggaaggggctgggaggttgggggtttggtttcgtacaggaagactaaaagtattagtgggtaggaaccacccgtagacttaccggcccgtcgtactggtaagaaagacagtacttacaactaaattcacaaagacgtaatacgtaacttaacccgaaaagctaatccgaccttatacctagaaccaaagtcgaaacgcgaccctaagggaaacgaccggaaggtaaccacgtacggtaccgttagttaattaacgtcgttaacgtccgaacgtaccccgtaccgttagttaacgttcgggtaacccttgtcgtttcgacgttacggttcggggaaccgtaaccgggg

SEQ ID NO: 440027 - DNA, 696 bp, Homo sapiens
  misc_feature: GZ8MTXP01BV0GV.21.75.G09.1.454.CMB.2.raw
  modified_base (258)..(258): a, c, t, g, unknown or other
  modified_base (271)..(271): a, c, t, g, unknown or other
  modified_base (282)..(282): a, c, t, g, unknown or other
  modified_base (295)..(295): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggtttcctgttgctacttaaaggtgtccaatgtgaggtgcagctgggtggagtcgtggggggagtatttggtacaggccgaggggccggtccctgagactctcctgtacacctntgattcacttggngattatgctangagtctcggtccncgaggctcggaggggaggggcgtgggtaggttgggttggtttcgtacgaggaacgtacgaaagtagttagtgggtaggaaccacccgagtacgttaccgccgtcgttactaggtaacgaaacgtaccgtagtactttacgaactaaacttctacaaaggacgtaagtaggtaaacttaacccgaaaaacgctaacgttcccggaccttaattcctaaggtaacctaaagggtacgaacgacgtacccgtaaggaaaccggaacccggaacggaaaccgacgtacggtacgttacgttaaacttaacgtagttacgtaccgttaccgtaacccgttaccgttagttaacgttccgggtaactcgttaacttacgacgttacggtccgggaaccgtaaccggg

SEQ ID NO: 440028 - DNA, 701 bp, Homo sapiens
  misc_feature: GZ8MTXP01D939S.21.75.G09.1.454.CMB.2.raw
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggagtagttttggtacaggccgaggggccggtccctgagactctcctgtacaacctctgattcacctttggtgtattatgctatgagcgttcggttccgccgaggcctaccggagggggaacgggtcgtgggtaggttgggggtttcggtttcgtacgaaggaagacgaaaggtattagtagggtacgaaacacccgaggtacttaccggcccgtacgttacgtaggtaagaaaagacaagtacttacaactaaactctacaagagtaagtagtaacttaaccgaaaaagctaactccgaccttacgtctagtaaccaaaggttacgaaacgtacgacccgtaaggaaacgaccggaacggaaccacgtacggtacgtacgttaactaacttacgttacgtccgttaacgtacccgttaccgttaacgttacgttacggggtaacctcggttctttacggtaccgttacgggtccggggccgtaaacccgggg

SEQ ID NO: 440029 - DNA, 762 bp, Homo sapiens
  misc_feature: GZ8MTXP01C23X2.21.75.G09.1.454.CMB.2.raw
tcagtcgtcgctcgcacgaccggtgctcgatttagtatagacatcaggggggggagaggagccccagccgtgagattcccaggagtttccacttggtgatcagcactgaacacagaccaccaaccatggagttgggcttagcttgggttttccttgttgcttaactttaaaaggtgtccaatgtgaggtgcagcgtgggtggagtcgtgggggagtagtttggacagccgagggccggtccctgacgactctcctagtaccaacctctggtacttcctacgtttggtgtattactgtctagtgacgtcgttcggtcccgccgaggccgtacggagggggtaaggggcgttagggtagggttgggggttttcggttacgtacgaaaggtaaagtaacgtaaaaggtatttaaggtacgggtacggaaaacctaaccccgaagtaacgttccggcccgtcggttaacgtaggtaagaaaacgtacgtaagtaacttaccaaactaaatcctaaagaaaggtaataagtacgtaaacttaaacccgaaaagtcctaacttccgacttaacttcgaacaaactaaaacgtacgaaaaccgaccgaccgaaaggaaaccgacccggaagtaaaccagtaaccggttacgtaacgttaattaaccgttagttacccgtacgaaccgttaaccctccgttaaagcggttaccggggtaacctgttcgtttacgaaccggttacgggaaccgggttaacccgtaaccggg

SEQ ID NO: 440030 - DNA, 648 bp, Homo sapiens
  misc_feature: GZ8MTXP01ACMTP.21.75.G09.1.454.CMB.2.raw
  modified_base (255)..(255): a, c, t, g, unknown or other
  modified_base (367)..(367): a, c, t, g, unknown or other
  modified_base (534)..(534): a, c, t, g, unknown or other
tcagtcgtcgctcgcacgaccggtgctcgatttagtatagacatcagggggggagaggagccccagccgtgagattcccaggagtttccacttggtgatcagcactgaacacagaggactcaccatggagttttggctgagcttgggttttccttgttgcttatttacaaaaggtgtccagtgtgaggtgcaggttggtggagacgtggaggaggcttgatccgagccgtgggggtccctgagactctctgtgcngtctcgtggttcgtcgagtggacgactacagtgagtcgtcgggtcccgccgaggcctaccggagggacgggcgtggagtggatctctattattagtagtggtcgtaccccanatactacacaacgaccgtcgtagaaccgggtccgattcgaccatactacaagaacgaactaacgttaccgaaagaaactacgtattacgtaacttcgtaaacaaagtacgaaactaaccgtaggaacgaccggacggaacgacgaccggtacattagttacttacgngggtaaggtgggttcttacgtttacggtacccggtacccgggttcgggggcccggttaccgtccgggtacccaacccgttccctacccccgcctaacccgaaccggaaccccgg

SEQ ID NO: 440031 - DNA, 680 bp, Homo sapiens
  misc_feature: GZ8MTXP01AIE17.21.75.G09.1.454.CMB.2.raw
  modified_base (256)..(256): a, c, t, g, unknown or other
  modified_base (259)..(259): a, c, t, g, unknown or other
  modified_base (268)..(268): a, c, t, g, unknown or other
  modified_base (274)..(274): a, c, t, g, unknown or other
  modified_base (280)..(280): a, c, t, g, unknown or other
  modified_base (293)..(293): a, c, t, g, unknown or other
  modified_base (347)..(347): a, c, t, g, unknown or other
  modified_base (352)..(352): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagcgtggtggagtcgtgggggagtagtttggacagccgagggccggtcctgagctctctgtacacctntgnttcacttgntattangctagngagtctcggtccncaggctcggagggagggcgtggaggttgggtttggttcgcgagaagacaaagtnttagnggtacgaaccacccgaggtacttaccggccgtcggttactagggtaagaaaagaccaagtacttccgaaactaaacgtcctaacgaaagtaggtaactaggtaaaccttaaaccgaaaaagtcctaacgttacccgtacccttaactccgttaacggaactaaaacggttacgaaaccgacggacccgtaaggaaaccgaaccggaacgaaccgacgtacggtacccgttagttaacgttaactcggttacgtaccgaaccgtacccgtacgttaagttcggttcggtaactgtcgttagaccgttacggtcgggaaccgtaaccggg

SEQ ID NO: 440032 - DNA, 635 bp, Homo sapiens
  misc_feature: GZ8MTXP01C4GSW.21.75.G09.1.454.CMB.2.raw
tcagtcgtcgctcgcacgaccggtgctcgatttagtatagacatcaggggggggagaggagcccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggagtatttggtacaggccgaggggccggtccctgagactctcctgtacaacctctggattctacctttggtgattatgctatgagcgttgggttcccgccgaggcctaccgagggggaagggggcgtgggaggtgggggtttggtttcgtacgaggaagacaaaaggtatttagtgggtaggaaaccaacccccgaggtaacgttaccgacccggtcgttaacgttacggtaaggaaaaggacaagtacttcaactaaatctacaaagagatagtaacttaccaaaaagcaatccgaccttatctagacaaagtgaacagacctagaacgaccgagacactgtccgtagtataactgttactcgacgtacccgtcgttattagttcggaactgtctttgacttacggtcgggccgtaaccgggg

SEQ ID NO: 440033 - DNA, 657 bp, Homo sapiens
  misc_feature: GZ8MTXP01EOSAT.21.75.G09.1.454.CMB.2.raw
  modified_base (262)..(262): a, c, t, g, unknown or other
  modified_base (274)..(274): a, c, t, g, unknown or other
  modified_base (280)..(280): a, c, t, g, unknown or other
  modified_base (285)..(285): a, c, t, g, unknown or other
  modified_base (296)..(296): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggttttccttgttgcttactttaaaaggtgtccaatgtgaggtgcagctgggtggagtcgtgggggagtagtttggtacagccgaggggccgtccctgagactctcctgtacacctntgattcacttgntattangctangagctggtccncgaggcctcgaggggagggcgtggaggttgggtttggttcgacgaaggaacgacgaaagtattagtggtaggaaccacccgagtacgttacgcccgtacgtactagtaagaaagactagtacttacaaactaattctacgaaagagtatagtaacttaaccgaaaagtctaatcccgtaccttatccgtagaacctaaagtacgaaacgacgtaccgtaaggaaacgaaccggaaggaaccacgtacgtccgtagttacttaacgtcgttacgtaccgttaaccgtacccgttacccgttaagttacgttacgggtaacctgtctttacgaccgttacggtccggggaaccgtaacccggg

SEQ ID NO: 440034 - DNA, 878 bp, Homo sapiens
  misc_feature: GZ8MTXP01AW667.21.75.G09.1.454.CMB.2.raw
  modified_base (298)..(298): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggttttccttgttgcttactttaaaggtgtccaatgtgaggtgcagctgggtggagtcgtggggggatagtttggacaggccgagggccggtcctgagactcctcctgtaccacctctggtattctaccgttttggagtattagtgtactagngagtcgttcggttcccgccgacggtccgtaccggaagggggaacggggtcgtaggggtaggtttgggggtttggtttccggtacgaaggaaagtacgtaaaaggtatttaggtaggggtaacgaaaccctaacccgaaggtacgtttaacccggccccggttcggtaaccgttagggtaacgaaaacgtaccgtaaagtaaccttacccgaaactaaacgttaccctaacgaaaaggtagtaacgtaacggttaaaccttaaacccgaaaaaacggtcccttaaggttaccccgtaacccgttaacttaccggtaacgtaaaacccgttaaaaaaactttaccgaaacccgggttaccccgtaaaggggaaaaacccggtacccgggaaagaacccgtaaaccggtcggtaccccggtttaaggttaaaccctttcgggtaaacggttacccgttaaccgggtaacccgttccccgttaaacccgttagttaaacccgggttcggggaccctttcggtacgttttcgaaacccggttccgggttaccgggggtaaccccgttaacccgggttaaccccgg

SEQ ID NO: 440035 - DNA, 636 bp, Homo sapiens
  misc_feature: GZ8MTXP01AMYCS.21.75.G09.1.454.CMB.2.raw
  modified_base (258)..(258): a, c, t, g, unknown or other
  modified_base (272)..(272): a, c, t, g, unknown or other
  modified_base (278)..(278): a, c, t, g, unknown or other
  modified_base (283)..(283): a, c, t, g, unknown or other
  modified_base (294)..(294): a, c, t, g, unknown or other
  modified_base (330)..(330): a, c, t, g, unknown or other
  modified_base (334)..(334): a, c, t, g, unknown or other
  modified_base (342)..(342): a, c, t, g, unknown or other
  modified_base (347)..(347): a, c, t, g, unknown or other
  modified_base (468)..(468): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggatagtttggtacagccgagggccggtccctgagactctcctgacacctntggattcactttgngattangctangagctggtccncaggctccgagggagggctggagttggggtgttcgnaganacaaagtnttagnggtagaacaccccgagtattaccggccgtcgttactagtaagaaaacggtcaaggtactttcaaactaaatcctacaaaggagatagtaacttaacccgaaaagtctagtcccgacttacncgtagaactaaagtcggaaactcggtacctaaggaacgaaccgtaggaacctacgacggtccttagtattcgtcgttaccgtacgacgtacccttacccgttaattacggttcggccctttgtccgttttacggacgtttaccgggcggggttaacccgtaaccgggg

SEQ ID NO: 440036 - DNA, 715 bp, Homo sapiens
  misc_feature: GZ8MTXP01EM3TY.21.75.G09.1.454.CMB.2.raw
  modified_base (274)..(274): a, c, t, g, unknown or other
  modified_base (286)..(286): a, c, t, g, unknown or other
tcagtcgtcgctcgcacgaccggtgctcgatttagtatagacatcaggggggggagaggagccccagccgtgagattcccaggagtttccacttggtgatcagcactgaacacagaccaccaaccatggagtttgggcttagcttgggttttccttgttgcttaactttaaaaggtgtccaatgtgaggtgcagctgggtggagtcgtgggggatagtttggacagccgagggccgtcctgagactctcctgtacacctctgtattcactttgngtattatgctangagtctggtccgcgaggcctaccggaggggaagggtcgtggtaggttgggggtttgtttcgtgaagaagacgaaagtattagtagggtacgaacaaccccgaggtactaccgccgtcgtactaggtaagaaagacagtacttacaactaacttcctacgaagaaggtaatacggtaacttaacccaaaagtactaactacccggacctaacgttactacgaaactaaacgtaagaaacgtacgacccgtaagaaaccggaccggaaggaaaccaccgtaacgtaccggttacttaacgttaacgttaacgttaacctaccggttaaccgtaaccccgttacccggttaaacgttaaacgggttacggtaaccgttcgtaaccgtttacggtaccgttaccgggtaaccggggttaaccgtaacccgggg

SEQ ID NO: 440037 - DNA, 533 bp, Homo sapiens
  misc_feature: GZ8MTXP02JYYZA.21.75.G09.1.454.CMB.2.raw
  modified_base (341)..(341): a, c, t, g, unknown or other
  modified_base (365)..(365): a, c, t, g, unknown or other
  modified_base (478)..(478): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctgggggagatttggtacagccagggcggtccctgagactctcctgtacaacctctggattcacctttggtgattatgctatgagctggtccgcaggctccgagggagggctggagtgggttgttcgcagaagcaaagattanggtggaacacccagattacgccgngtctgtgaaagcagattcacaatctacaaagagatgattaccaaaagcatcgcctatctgacaaatgaacagcctagaacgaccgaggacacacgccgtagtattactgtacncgacaccctaccgtataagtcggaacctggtcttagactacgtcgggccaacggg

SEQ ID NO: 440038 - DNA, 655 bp, Homo sapiens
  misc_feature: GZ8MTXP02ILPN5.21.75.G09.1.454.CMB.2.raw
  modified_base (281)..(281): a, c, t, g, unknown or other
  modified_base (359)..(359): a, c, t, g, unknown or other
  modified_base (365)..(365): a, c, t, g, unknown or other
  modified_base (416)..(416): a, c, t, g, unknown or other
  modified_base (423)..(423): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagcttgggttttccttgttgcttactttaaaggtgtccaatgtgaggtgcagctgggtggagtcgtggggggagtattttgggtacaggccaggggccggtccctgagacctctcctgtacaacctctggattcacctttggnattatgctatgagctggttccgccaggcctccgaggggagggctgggagttggggtttggtttcgtcagaagcaaagntttagngggtagaacaccagattaccgccgcgttctgtagaaagacagtactccaanaatctanaagagatgattaccaaaagcatcgacctatctagactaaatacgaacacgaccgtaacgaacgaccggaaggaaccaacgacgtacccgttagttaactttaaccgttagttaaccgttaccggtaaaccggtaaccccgttaccccgttaaacgttaacgttacggggtaacccgttcggttccgttttacgtaaccgttaccggttacgggggtaacccgtaaccggggg

SEQ ID NO: 440039 - DNA, 553 bp, Homo sapiens
  misc_feature: GZ8MTXP02HIJPA.21.75.G09.1.454.CMB.2.raw
  modified_base (270)..(270): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccagggcggtccctgagactctcctgtacaacctctggattcacctttggngattatgctatgagctggttccgccaggctccgagggaggggctggagtggggttgtttcgcagaagcaaagtattatggtaggaacaccccgagattaccggccgcgtctgtgaaagacagattcaacaatctcaagagatgattaccaaaagcatcgctatctagacaaatgaacagacctagaaagaccgaggacacagccgtgacttactgtactcgacgacctcccgtaataacgtcgggaacctgtacctttgacgtacgtcggggacctaacgggg

SEQ ID NO: 440040 - DNA, 581 bp, Homo sapiens
  misc_feature: GZ8MTXP02HPM6X.21.75.G09.1.454.CMB.2.raw
  modified_base (326)..(326): a, c, t, g, unknown or other
  modified_base (331)..(331): a, c, t, g, unknown or other
  modified_base (348)..(348): a, c, t, g, unknown or other
  modified_base (493)..(493): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagatttggtacagccgagggcggtccctgagactctctgtacactctggattcaccttggtgattatgctatgagctggtccgccaggctccgagggagggctggagtgggttgttcgnagagnaagattagtggtgaacncccagattacgccgtcgtctgtgaaagacagtattcaacaaatcctacaagagatagattaccaaaagcatcgcctatctagacaaatgaaacagaccgtagaacgaccgaggacacgagtaccgtagtaacttactggttaccncgtaacgtacccttacccgtaagtaacgtcggggtaaccttcgtacgttttacgacctttaccggtacgggggtactaaacccggggg

SEQ ID NO: 440041 - DNA, 535 bp, Homo sapiens
  misc_feature: GZ8MTXP02IXZ4C.21.75.G09.1.454.CMB.2.raw
  modified_base (267)..(267): a, c, t, g, unknown or other
  modified_base (339)..(339): a, c, t, g, unknown or other
  modified_base (368)..(368): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctacttaaaggtgtccaatgtgaggtgcagctggtggagtctgggggagatttggtacagccagggcggtccctgagactctcctgtacactctggattcacctttggtnattatgctatgagctggttccgccaggctccgaggggagggctggagtggggttgtttcgcagaagcaaagnttatggtaggaacacccagattacgccgngtctgtgaaagcagattcaacaatctacaagagatgattaccaaaagcaatcgcctatctgacaaatgaacagccagaacgaccgaggacaacagaccgtgtacttactgtactcgacgacctaccgtataagtggaacctgtctttgactacgtcgggccaacggg

SEQ ID NO: 440042 - DNA, 560 bp, Homo sapiens
  misc_feature: GZ8MTXP02GMK89.21.75.G09.1.454.CMB.2.raw
  modified_base (293)..(293): a, c, t, g, unknown or other
  modified_base (347)..(347): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctgggggagatttggtacagccagggcggtccctgagactctcctgtacaacctctggattcacctttggtgattatgctatgagctggttccnccaggctccgaggggaaggggctggagtggggttgtttcgtcagaagcaaaagnttagtggtgaacacccagattacgccgcgtctggtgaaagacagtattcaacaatcctacaagagatgattacccaaaagcatcgcctatctagacaaatgaacacgcctagaacgaccgaggaacacacgccgtagtacttactgtactcgacgacctcccgtaataacgtgggaacctggctttcgactacggtcgggaccgtaaccgggg

SEQ ID NO: 440043 - DNA, 641 bp, Homo sapiens
  misc_feature: GZ8MTXP02JCVW3.21.75.G09.1.454.CMB.2.raw
  modified_base (345)..(345): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagtatttggtacagccgagggccggtccctgagactctcctgtacacctctgattcactttggtgattatgctatgagcgtcggttcccgcaggcctaccggaggggaagggctgggtaggttggggtttggtttcgngaaggaagacgaaaagtatttagtggtaacggaaccacccgagtacttaccgccgtacgtcttgtagaaagacagtacttacaactaaatctacgaaagagtagtagtaacttaacccgaaaagtcaactaccgtacctatccgtaagaacctaaaagtacgaaaccacggtacccgaagaaacggaccggaacggaacctacgacggtacctagtaactttacgacgtactaccgactaccgtaccgtaatacgtcggaactcgtacgttacgacgtacggcggaccgtaaccgg

SEQ ID NO: 440044 - DNA, 596 bp, Homo sapiens
  misc_feature: GZ8MTXP02HLHAS.21.75.G09.1.454.CMB.2.raw
  modified_base (274)..(274): a, c, t, g, unknown or other
  modified_base (279)..(279): a, c, t, g, unknown or other
  modified_base (342)..(342): a, c, t, g, unknown or other
  modified_base (347)..(347): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagatttggtacagccaggggcggtccctgagactctcctgtacaacctctggattcacctttggtnattangctatgagctggtccgcaggctcgaggggagggctggagtgggttggttcgcagaagcaaagnttagnggtaggaacaccccagtacttaccgccgcgtctggtagaaagacagtacttcaacaaatctacaaagagatgattaccaaaagcaatccgacctatctagacaaatcgaaacacgacctaggaaacgacccggaaggaaccacgacggaccgtagttaacttacgtagtacctacggacgtacccgtacccgtaataacgtcgggaaccttggtacctttcgaacgttacggcggggtaccgaaccggg

SEQ ID NO: 440045 - DNA, 565 bp, Homo sapiens
  misc_feature: GZ8MTXP02FPE0J.21.75.G09.1.454.CMB.2.raw
  modified_base (269)..(269): a, c, t, g, unknown or other
  modified_base (342)..(342): a, c, t, g, unknown or other
  modified_base (346)..(346): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttcctgttgctactttaaaggtgtccaatgtgaggtgcagctggtggagtctggggggagatttggtacagccagggcggtccctgagactctcctgtacaacctctggattcacctttggngattatgctatgagctggttccgccaggcctccaggggagggctggagtgggttgtttcgtcagaagcaaagnttanggtggaacacccgagattacgccgcgtctgtgaaagacagattcaacaatctacaagagatgattaccaaaagcatcgcctatctagacaaatcgaaacacgacctagaacgaccggaggaccacgagccgtgttaacttactgttacctcggaacgaccctcccggtaataacgtcggggaacctggtactttcgactacgcggggaccctaacgggg

SEQ ID NO: 440046 - DNA, 585 bp, Homo sapiens
  misc_feature: GZ8MTXP02G1NAA.21.75.G09.1.454.CMB.2.raw
  modified_base (267)..(267): a, c, t, g, unknown or other
  modified_base (352)..(352): a, c, t, g, unknown or other
  modified_base (377)..(377): a, c, t, g, unknown or other
  modified_base (399)..(399): a, c, t, g, unknown or other
  modified_base (429)..(429): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtctgggggagatttggtacagccagggcggtccctgagactctctgtacacctctggattcactttggngattatgctatgagctggttccgccaggctccgaggggaagggctggaggtggggttggttcgtcgagaagacaaaggatttagnggtagaacacccagacttacgccgngtctgtgaaagacagattcaanaatctacaaagagatgattaccaaaagcancgcctatctagacaaatagaacagcctagaaacgacgaggaacaacgacgaccgtagtaacttacgtacgtactacggaacgaccccgttacccgtaataaacgtcgggaacctcgtacgtttacgaccttacggacggggtacccgaaaccgggg

SEQ ID NO: 440047 - DNA, 580 bp, Homo sapiens
  misc_feature: GZ8MTXP02ITH93.21.75.G09.1.454.CMB.2.raw
  modified_base (272)..(272): a, c, t, g, unknown or other
  modified_base (500)..(500): a, c, t, g, unknown or other
  modified_base (515)..(515): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagatttggtacagccaggggcggtccctgagactctcctgtacaacctctggattcacctttggngattatgctatgagctggttccgccaggctccgaggggaaggggctggagtggggttggtttcgtcgagaagcaaaagatttagtgggtaggaaaccaccccgagtactttaccgccggtcgttccttggtgaaaagacaagtattaccaacaaattctacaaagagatagattaccaaaagcaatcgacctatctgacaaatgaacagctagaagaccgaggacacngaccgtgtacttacngtactcgacacctccgtaatacgtcggaacctgtactttacgactacggtcgggaccgtaacggg

SEQ ID NO: 440048 - DNA, 585 bp, Homo sapiens
  misc_feature: GZ8MTXP02G7ANO.21.75.G09.1.454.CMB.2.raw
  modified_base (266)..(266): a, c, t, g, unknown or other
  modified_base (272)..(272): a, c, t, g, unknown or other
  modified_base (328)..(328): a, c, t, g, unknown or other
  modified_base (340)..(340): a, c, t, g, unknown or other
  modified_base (370)..(370): a, c, t, g, unknown or other
  modified_base (374)..(374): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagagtttggtacagccagggcggtccctgagactctctgtacactctgattcacttggngattangctatgagctggtccgccaggctccgaggggagggctggaggtgggttggttcgtnagaagcaaagtnttagtggtagaacacccagtactacgccgngtcngtgaaagacagtacttcaataactctacaagagatagacttacaaaagcatcgactatctagacaaatacgaacaggggacctaggaaacgaccggaggacacgacgtccgtagtacttactacgtactcgaacgtacccgttaccgtaacgtaacgtacggtaaccgttcgtacgtttacgacgttacggtacggggaccgtaaccgggg

SEQ ID NO: 440049 - DNA, 559 bp, Homo sapiens
  misc_feature: GZ8MTXP02IN46X.21.75.G09.1.454.CMB.2.raw
  modified_base (268)..(268): a, c, t, g, unknown or other
  modified_base (351)..(351): a, c, t, g, unknown or other
  modified_base (366)..(366): a, c, t, g, unknown or other
  modified_base (377)..(377): a, c, t, g, unknown or other
  modified_base (386)..(386): a, c, t, g, unknown or other
  modified_base (393)..(393): a, c, t, g, unknown or other
  modified_base (397)..(397): a, c, t, g, unknown or other
  modified_base (399)..(399): a, c, t, g, unknown or other
  modified_base (442)..(442): a, c, t, g, unknown or other
tcagtcgtcgctcgcacgaccggtgctcgatttagtatagacatcagggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggagatttggtacagccagggcggtccctgagactctcctgtacaacctctggattcacctttggngattatgctatgagctggttccgcaggctccgagggagggctggagtgggttgttcgtcagaagcaaagattatggtggaacnccgagattacgccgngtctgtgaaancagattcanaaatcanaganangattaccaaaagcatcgcctatctagactaaatacgaaacacnccgtagaaacgaccgaaggacacgacgccgtagtattactagtactacgacgtacctacccgtaataacgtcgggtaacctcgtctttacgaccgttacgtcggggacctaacgggg

SEQ ID NO: 440050 - DNA, 621 bp, Homo sapiens
  misc_feature: GZ8MTXP02I2YJB.21.75.G09.1.454.CMB.2.raw
  modified_base (304)..(304): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagtattttgggtacaggccagggggccggtccctgagactctcctgtacaacctctggattcacctttggtgtattatgctatgagctggtcccncaggcctccgaggggagggcgtgggaggtgggttggttcgcgagaagcaaagtattagtggtaggaaccacccgagacttaccggccgtcgtcgtggtagaaaacgacaagtacttaccaactaaatcctacaaagagaatagtaacttaaccaaaagccaagtacccgaccttatccgtagaacaaaagtacgaaacacgaccgtaaggaaacgaccggagaacacgacgtccgtagtacttacgtgtactacgacgtaccctaccgtaatacgtcggaacctgtcgttacgacgttacggcgggaccgtaacggg

SEQ ID NO: 440051 - DNA, 588 bp, Homo sapiens
  misc_feature: GZ8MTXP02HM7OV.21.75.G09.1.454.CMB.2.raw
  modified_base (268)..(268): a, c, t, g, unknown or other
  modified_base (291)..(291): a, c, t, g, unknown or other
  modified_base (329)..(329): a, c, t, g, unknown or other
  modified_base (341)..(341): a, c, t, g, unknown or other
  modified_base (378)..(378): a, c, t, g, unknown or other
  modified_base (441)..(441): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccagggcggtccctgagactctcctgtacaactctggattcactttggngattatgctatgagctggttccnccaggcctccgaggggagggctggagtgggttgttcgnagaagcaaagtnttagtggtagaacaccccagattaccgccgtgtctgngaaaagcagtattcaacaattctacaaagagatgaattaccaaaagcaatcgtacctatctanactaaagtacgaaacacgaccgtaagaaaccgaaccggaaggaaccaacgacgtaccgttagttaacttacgtacgtactacgaccgtaccgtaccgtaataacgtcggtaacgtcgtcgttacgacgtacggtcgggtaccgacgg

SEQ ID NO: 440052 - DNA, 646 bp, Homo sapiens
  misc_feature: GZ8MTXP02I4ZL5.21.75.G09.1.454.CMB.2.raw
  modified_base (271)..(271): a, c, t, g, unknown or other
  modified_base (328)..(328): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagatttggacagccaggggcggtccctgagactctcctgtacaacctctggattcacctttggngattatgctatgagctggtccgcaggctccgaggggaggctggagtgggttgttcgnagaagcaaagtattagtggtaggaacaccccgagtagttacgccgcgtctgtaggaaaacgacagtacttacaactaaatcctacaaagagtatacgtaattaacccgaaaagccaagtcctacccttatctagaaaccaaaagtcgaaaccacgtacccgtaaggaaaacggacccggaaaggaaccaacgaacggtcccgttaagtaactttacgtacggtacctaccggtaaacgtacccgttacccgtaaaagtacgtacggggtaacccttggtccttttacggacctttacgggcggggaccgtaaccgggg

SEQ ID NO: 440053 - DNA, 577 bp, Homo sapiens
  misc_feature: GZ8MTXP02I6LBK.21.75.G09.1.454.CMB.2.raw
  modified_base (269)..(269): a, c, t, g, unknown or other
  modified_base (437)..(437): a, c, t, g, unknown or other
  modified_base (487)..(487): a, c, t, g, unknown or other
tcagtcgtcgctcgcacgaccggtgctcgatttagtatagacatcaggggggagaggagccccagccgtgagattcccaggagtttccacttggtgatcagcactgaacacagacccaccaaccatggagtttgggcttagctgggttttccttgttgctactttaaaggtgtccaatgtgaggtgcagctggtggagtcgtgggggagatttggtacagccagggcggtccctgagactctcctgtacacctctgattcacctttggngattatgctatgagctggttcccgccaggcctccgagggagggctggagtgggttgtttcgtcagaagcaaagtattagtggtaggaacacccgagtacttaccgccgtcgtctgtagaaacgacaagtattcaactaaatctacgaagagatgaattacccgaaaancaatcgactatctagacaaagtgaacagactagaacgacgaggacaacgngtaccgtagttacttacgtagtactacgacgtaccctaccgtaatagtcggtaaccgtgtcgttacgacgtacgtcgggaccgtaacggg

SEQ ID NO: 440054 - DNA, 597 bp, Homo sapiens
  misc_feature: GZ8MTXP02HZDAV.21.75.G09.1.454.CMB.2.raw
  modified_base (271)..(271): a, c, t, g, unknown or other
  modified_base (276)..(276): a, c, t, g, unknown or other
  modified_base (292)..(292): a, c, t, g, unknown or other
  modified_base (331)..(331): a, c, t, g, unknown or other
  modified_base (348)..(348): a, c, t, g, unknown or other
  modified_base (423)..(423): a, c, t, g, unknown or other
  modified_base (432)..(432): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtctggggggatatttggacagccaggggcggtccctgagactctcctgtacaacctctggattcactttggtnattangctatgagctggtccncaggctacgaggggaagggctggagtggggttggtttcncgaagaagacaaaagtnttaagtgggaggaaacaccccgaagtacttacgccgtacgtcgtgagaaaagcaagtattacaacaaattcaaanaagatatanaactaacaaagcacgtacgacttatacagacaaatagaacacgacgacgaacgaacgaacgaacgaacgacgacgtacgtacttactacgtacgtacgtacgtaccgtaccgtaacgtaacgtacgtaacgtacgtacgtacgtacgtacgtacggacggtacgg

SEQ ID NO: 440055 - DNA, 654 bp, Homo sapiens
  misc_feature: GZ8MTXP02FO35R.21.75.G09.1.454.CMB.2.raw
  modified_base (357)..(357): a, c, t, g, unknown or other
  modified_base (362)..(362): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagtagttttggtacaggccaggggccggtccctggagacctctcctgtacaacctctggattcacctttggtgattatgctatgagctggttcccgcaggctccgaggggaagggctggagtgggttggttcgtcagaagcaaaggtnttagnggtaggaacacccagtattacgccgtcgtctgtgaaagcagattccaataatctacaagagatagtaacttaaccaaaagcaatccgtactactctagactaaaatcgaaacacgtaccctaggaaaccgaccggaaggaaccaacgacggaccgtagttaacgttacttacggtacctacggtaacgtaaccccgttacccgtaaagtaaaacggttccgggggtaaccttcggttaccgtttttacggaaccgtttacgggtcccgggggtaccctaaaaccccgggggg

SEQ ID NO: 440056 - DNA, 608 bp, Homo sapiens
  misc_feature: GZ8MTXP02JRB7M.21.75.G09.1.454.CMB.2.raw
  modified_base (207)..(207): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctggggganatttggtacagccagggcggtccctgagactctcctgtacaacctctggattcacctttggtgattatgctatgagctggttcccgcaggctccgaggggaaggggctggaggtggggtttggtttcgtcgagaagcaaaagtattaagtggtaggaaacacccagtattacgccgtcgtctggtagaaagacagtattcaactaaatcctacaagagatagaattaaccaaaagctaatccgacctatcgtagactaaaatagaaactacgacgtagaaacggaccggaacggacacgacgccgtagtaacttactacgtacgtacgaccgtacccttacccgtaataacgtcggaaccgtgttcgttacgtacgtacggtaccggggaccgtaaccggg

SEQ ID NO: 440057 - DNA, 587 bp, Homo sapiens
  misc_feature: GZ8MTXP02JCRKV.21.75.G09.1.454.CMB.2.raw
  modified_base (207)..(207): a, c, t, g, unknown or other
  modified_base (269)..(269): a, c, t, g, unknown or other
  modified_base (292)..(292): a, c, t, g, unknown or other
  modified_base (317)..(317): a, c, t, g, unknown or other
  modified_base (346)..(346): a, c, t, g, unknown or other
  modified_base (376)..(376): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctggggganatttggtacagccagggcggtccctgagactctcctgtacaacctctggattcacctttggngattatgctatgagctggttccnccaggcctccgaggggagggctggngtgggttggtttcgtcaagaagcaaagtnttagtggaggaacacccagacttacgccgngtcctgtgaaagacagattcaacaatctacaagagatagattaccaaaagcatcgctatctagacaaatgaacagacctagaaacgacccggaaggaccaacgacgaccgtagtatttacctggtacctcgaacgtaccctacccggtaactaaggtcgggaacctcggttactttacggacttacggtacgggggaccgtaaacccgggg

SEQ ID NO: 440058 - DNA, 681 bp, Homo sapiens
  misc_feature: GZ8MTXP02G5TMX.21.75.G09.1.454.CMB.2.raw
  modified_base (269)..(269): a, c, t, g, unknown or other
  modified_base (333)..(333): a, c, t, g, unknown or other
  modified_base (347)..(347): a, c, t, g, unknown or other
  modified_base (352)..(352): a, c, t, g, unknown or other
  modified_base (384)..(384): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagtagtttggtacagccgagggcggtcctgacgactctctgtacacctctgattcacttgtnattatgctatgagctcggtccgccgaggctaccggaggggagggctgggagtggggttgttcgngaagagacaaagtnttagngggtacgaacaccccgagtacgttaccgccgngttcgtagtagaaagtacgaagtaacttaccgaaacaaatttccgtaacgaaagtaagtaagtacgtaaactttaaacccgaaaaaacggtcctaaacttcccggtaccctaagttaccgttacgaaacccaaaagttacgaaacgtaccgaccgtaaggaaaccggaccggaacggaacaccgtacggtacgtagttacttaacgtcgtacgtacggacgtacccgtaccgtaatacggtacggaacgttcgtacgtttacggaaccgttacgggtccggggaccgtaacccgggg

SEQ ID NO: 440059 - DNA, 610 bp, Homo sapiens
  misc_feature: GZ8MTXP02G45JQ.21.75.G09.1.454.CMB.2.raw
  modified_base (209)..(209): a, c, t, g, unknown or other
  modified_base (268)..(268): a, c, t, g, unknown or other
  modified_base (274)..(274): a, c, t, g, unknown or other
  modified_base (451)..(451): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggganatttggtacagccagggccggtcctgagactctcctgtacacctctgattcactttggngattangctatgagctggtccgccaggcctccgaggggaaggggcgtggaggttggggtttggtttcgtacgagaaagcaaaaggtatttagtgggtacggaaacaccccgaaggtactttaaccgcccggtacgttccttgggtagaaaagaccaggtacttaccaaacgtaaatccctaanaaagaggtaattaggaacttaacccaaaagcacttccgaccttatcttagacaaatcgaactagacctagaacgaccggaggacacgagccgtagtactactgtactcgacgacctcccgtatacgtcggaactgctttcgactaggtcggcgtaacgg

SEQ ID NO: 440060 - DNA, 590 bp, Homo sapiens
  misc_feature: GZ8MTXP02FYI83.21.75.G09.1.454.CMB.2.raw
  modified_base (207)..(207): a, c, t, g, unknown or other
  modified_base (269)..(269): a, c, t, g, unknown or other
  modified_base (420)..(420): a, c, t, g, unknown or other
  modified_base (490)..(490): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctggggganatttggtacagccagggcggtccctgagactctcctgtacaacctctggattcacctttggngattatgctatgagtctggttcccgccaggctccgaggggaaggggctggagttggggtttggtttcgtcgagaagcaaagtattatgggtagaacacccagacttacgccgtcgtctggtgaaagacagtattcactaaatctacaaganatagaattaccaaaagcagtccgcctatctagacaaagtgaaacagtaccagaaacgacgaaggacaacnggtaccgtgtaacttacgtcgtaacttcgacgtaccctaccgttaatagtacgggtccttagcctttacggaccttacggacggggcccgtaaaccgggg

SEQ ID NO: 440061 - DNA, 624 bp, Homo sapiens
  misc_feature: GZ8MTXP02GDR0K.21.75.G09.1.454.CMB.2.raw
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtggggggagatttggtacagccaggggccggtccctgagactctcctgtacaacctctggattcacctttggtgattatgctatgagtcgtggtccgcaggcctccggaggggaggggctgggaggttggggtttggtttcgtcaggaagcaaaagtattagtggtacggaacaccccgagacttaccgccgtcgtctaggtagaaaagacagtacttcaaacaaatctaacaaagagtatagtaacttaaccaaaaagcctaatacccgtacctatctagaacaaatacgaaacacgaccctaaggaaaccgaaccggaaggaccgacacgtaccgtagtaacttactacgtactcgaacgtaccctacgtaactagtcggaacctcgtacgtttcgacgtacggtcgggaccgtaacggg

SEQ ID NO: 440062 - DNA, 628 bp, Homo sapiens
  misc_feature: GZ8MTXP02GZ2M7.21.75.G09.1.454.CMB.2.raw
  modified_base (263)..(263): a, c, t, g, unknown or other
  modified_base (276)..(276): a, c, t, g, unknown or other
  modified_base (281)..(281): a, c, t, g, unknown or other
  modified_base (438)..(438): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggttttccttgttgctaactttaaaaggtgtccaatgtgaggtgcagctgggtggagtcgtggggggagtagtttggtacagccgaggggccggtccctgagactctctgtacacctntgattcacttggngattntgctatgagctggtcccgcgaggctccgaggggacgggcgtgggaggttggggtttggttcgtacgaaggaaagactaaaagtattaagtggggtacggaaaccaccccgaagtacttaccggccgtcgttctaggtagaaagacaagtactacaanaactcaacaaagatatagaacttaaccaaaagcctaatccgacctatcgtagaactaaaatcgaaacacgtacgtaagaaaccgaccggaaggaacctacgacgtacgtatatactgtactacgactacccgtaccgtaaatacgtacggaacctgtactttacgacgttacggcgggtaccgaaccggg

SEQ ID NO: 440063 - DNA, 652 bp, Homo sapiens
  misc_feature: GZ8MTXP02JDJSG.21.75.G09.1.454.CMB.2.raw
  modified_base (267)..(267): a, c, t, g, unknown or other
  modified_base (277)..(277): a, c, t, g, unknown or other
  modified_base (281)..(281): a, c, t, g, unknown or other
  modified_base (428)..(428): a, c, t, g, unknown or other
tcagtcgtcgctcgcacgaccggtgctcgatttagtatagacatcagggggggagaggagccccagccgtgagattcccaggagtttccacttggtgatcagcactgaacacagacccaccaaccatggagtttgggcttagctgggttttcctgttgctactttaaaggtgtccaatgtgaggtgcagctggtggagtcgtgggggagatttggtacagccagggcggtccctgagactctcctgtacactctgattcaccttggngattatgctntganctggttccgccaggctaccgaggggaaggggctgggaggttggggttggtttcgtcgaaggaagcaaaaggtattagtgggtaggaaccaccccagactttacggcccgtcgtctggtgaaagacagtacttcacaatctacaaganatgataccaaaagcaatcgctatctagactaaaatcgaaacagacccgtagaaacgacccggaaggacctaacgacggtaccgtaggttacttaaccgtacggttacctaccggaaaccggtacccccttaaccgttaaacttaacggtacggggtaaccccgttaggttacccttttacgggaaccttacccggggtacgggggtaccccgtaaacccggggg

SEQ ID NO: 440064 - DNA, 570 bp, Homo sapiens
  misc_feature: GZ8MTXP02JCX1Q.21.75.G09.1.454.CMB.2.raw
  modified_base (206)..(206): a, c, t, g, unknown or other
  modified_base (266)..(266): a, c, t, g, unknown or other
  modified_base (272)..(272): a, c, t, g, unknown or other
  modified_base (345)..(345): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttcctgttgctactttaaaggtgtccaatgtgaggtgcagctggtggagtctggggganatttggtacagccagggcgtccctgagactctcctgtacaacctctggattcactttggngattangctatgagctggttcccgccaggctccgaggggaaggggctgggagtgggttggtttcgtcagaagcaaagtnttagtggtggaacaccccgagattacgccgtgtcgtgtgaaagacagattccaacaatcctagaaagagatgattaacccaaaagccaatccgcctatacgtgaccaaaatgaacaacgcctagaaacgaccgagggacacgagaccgtagtattactgtaactcgaagtacctacccgtaactaagtcggaactcgtctttagactacgtggggcccaacgggg

SEQ ID NO: 440065 - DNA, 590 bp, Homo sapiens
  misc_feature: GZ8MTXP02FRYRU.21.75.G09.1.454.CMB.2.raw
  modified_base (206)..(206): a, c, t, g, unknown or other
  modified_base (268)..(268): a, c, t, g, unknown or other
  modified_base (343)..(343): a, c, t, g, unknown or other
  modified_base (373)..(373): a, c, t, g, unknown or other
  modified_base (384)..(384): a, c, t, g, unknown or other
  modified_base (394)..(394): a, c, t, g, unknown or other
  modified_base (402)..(402): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggtttcctgttgctactttaaaggtgtccaatgtgaggtgcagctggtggagtcgtggggganatttggtacagccagggcggtccctgagactctcctgtacaacctctggattcacctttggngattatgctatgagctggttccgccaggcctcgaggggaagggctggagtgggttggttcgtcagaagcaaagtnttagtggtaggaacacccgagattacgccngtctgtgaaancagattcaanaatcctanaaagagatagaattacccaaaagcaatcgacctatactagacaaaatgaaacacgaccctagaacgaaccgaggacaacgacgtaccgtagttaacttacgtcgtaacgttacgaacgtaacccttcccggtaaataacgtacgggaacctgtctttacgacctaacggtcggggacctaaaccgggg

SEQ ID NO: 440066 - DNA, 714 bp, Homo sapiens
  misc_feature: GZ8MTXP02GVNUT.21.75.G09.1.454.CMB.2.raw
  modified_base (267)..(267): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtgggggagatttggtacaggccagggcggtccctgagctctctgtacactctgattcacttgtntattatgctatgagcgtcggttcccgccgaggcctaccggaaggggaacggggcgtggggtaggtttggggtttcggtttcggtacgtaaggaacggtaacaaaaggtatttaagtaggggtaacggaaacaaccccgtagtacgttaccggcccgtcgttctaggtaggaaacgtacgaacgtattaccaactaaatccctaaagaaagtagatacggaacttaaaccgaaaacgctaacgtaccgtaccttacttacgtacgaacgaaaattacgaaaaccgacgtaaccgtaacggaaaaccgaaaccgggaacggaacccgtaaacgcggtacccggttagttaactttaacgttacggtacctacggaaccgtaccgtaaccccgtaataacggtacggaacgtcgtacttcggacctacgggaccgggaccgtaaccgggg

SEQ ID NO: 440067 - DNA, 609 bp, Homo sapiens
  misc_feature: GZ8MTXP02G4IOV.21.75.G09.1.454.CMB.2.raw
  modified_base (271)..(271): a, c, t, g, unknown or other
  modified_base (419)..(419): a, c, t, g, unknown or other
  modified_base (467)..(467): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccgaggggccggtccctgagactctcctgtacactctggattcactttggngattatgctatgagctggtccgccaggcctccgaggggaggggcgtgggaggtggggtttggtttcgtcgagaagacaaagtattaagtgggtaggaacaccccgagtacttacgccgcgtctgtgaaagcagattacaacaatctanaagagatgaattaccgaaagcatccgactatcagacaaagtcgaaacncgtacctaagaacggaccgaaggacacgacgtccgtagttacttacgagttacctcggaaccgtacccttaccgtaaatacggttacggggaacccttgtaccgttttacgaacgtttaccggcggggacccgtaacccggg

SEQ ID NO: 440068 - DNA, 596 bp, Homo sapiens
  misc_feature: GZ8MTXP02I0ZPD.21.75.G09.1.454.CMB.2.raw
  modified_base (207)..(207): a, c, t, g, unknown or other
  modified_base (292)..(292): a, c, t, g, unknown or other
  modified_base (347)..(347): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctggggganatttggtacagccagggcggtccctgagactctcctgtacaacctctggattcacctttggtgattatgctatgagctggttccnccaggctccgaggggaaggggctgggagtgggttggtttcgtcagtaagcaaagnttagtggtaggaacaccccagattacgccgtcgtctgtggaaagacagattcaacaatctacaagagatgattaccaaaagcaatcgcctatctagacaaatcgaacacgacctagaaacgaccggaggacaacgacgacccgtagttaacttacgtagttaaccgtcgaacggtacccttaccccggtaataacgtcgggaaccttcggtcttttacggaccttacggtcggggacccgtaaccgggg

SEQ ID NO: 440069 - DNA, 635 bp, Homo sapiens
  misc_feature: GZ8MTXP02IQXZ4.21.75.G09.1.454.CMB.2.raw
  modified_base (256)..(256): a, c, t, g, unknown or other
  modified_base (271)..(271): a, c, t, g, unknown or other
  modified_base (433)..(433): a, c, t, g, unknown or other
  modified_base (495)..(495): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggatagttttggacagccgagggccggtcctgagactctctgtacacctntgattctactttggntattatgctatgagtctcggtccgccgaggcctaccggaggggacgggtcgtggaggttggggttcggttcgtacgaaggaagactaaagtattagtggtacgaacacccgagtacttaccgcgtcgtcgtgtagaaagcagtacttacaactaaatctaanaagagtatagtaacttaaccgaaaagtctacgtaccacctatctagaacaaagtacgaaacngtaccgagaaccgaccgaagacacgacgtaccgtattaacttacgtacgttaccgtacgtaacgtacccgttaccgtaagttaacggtacgggtccttacggtcgtttacgacgttacgggacgggtaccgtaacccggg

SEQ ID NO: 440070 - DNA, 564 bp, Homo sapiens
  misc_feature: GZ8MTXP02IRFTG.21.75.G09.1.454.CMB.2.raw
  modified_base (209)..(209): a, c, t, g, unknown or other
  modified_base (296)..(296): a, c, t, g, unknown or other
  modified_base (349)..(349): a, c, t, g, unknown or other
  modified_base (415)..(415): a, c, t, g, unknown or other
  modified_base (437)..(437): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtctgggggganatttggtacagccagggccggtccctgagactctcctgtacaacctctggattcacctttggtgatttatgctatgagctggttccnccaggctccgaggggagggctgggagtggggttggttcgtcagaagcaaaagnttatgggtaggaacacccagattacgccgcgtctgtagaaagacagattcaataaatctacaaganatgattacaaaagcatcgctanctagaccaaatacgaacacgacctagaacgacgaggacacgagtccgtagtattactgtactcgtacgacctcccgtaataacgtcggtaaccgtcgtcttacgactacgtcgggaccgtaaccggg

SEQ ID NO: 440071 - DNA, 724 bp, Homo sapiens
  misc_feature: GZ8MTXP02G7B2B.21.75.G09.1.454.CMB.2.raw
  modified_base (273)..(273): a, c, t, g, unknown or other
  modified_base (301)..(301): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccaggggcggtccctgagactctcctgtacacctctggtattctacctttggngtattatgctatgagcgttcggttcccnccgaggtcctacccggaagggggaacggggtcgtaggggtaggtttgggggtttggtttccgtacgaaggaaacgactaaaaggtatttagtgggtacggaaaccaaccccgtaggactttaccggccgtcgttacgtgtagaaaggacagtacttacaacaacgtctacaaaggagtaactagtaacttaaccgaaaagtccatccgtacctatacttacgaaacaaacgtacgaaacgacgacccgtaaaggaaaccggaaccggtaacggaaacgaacgtaacggtccgttaggttaactttaaccgtaccgttactaccggaacgtacccccgttaacccgtaaagttaacggtacccgggtaacgttcgttaccgttacgtaaccggtaccgggtacgggggacccgtaaacccgggg

SEQ ID NO: 440072 - DNA, 603 bp, Homo sapiens
  misc_feature: GZ8MTXP02JRGLV.21.75.G09.1.454.CMB.2.raw
  modified_base (267)..(267): a, c, t, g, unknown or other
  modified_base (272)..(272): a, c, t, g, unknown or other
  modified_base (288)..(288): a, c, t, g, unknown or other
  modified_base (323)..(323): a, c, t, g, unknown or other
  modified_base (333)..(333): a, c, t, g, unknown or other
  modified_base (365)..(365): a, c, t, g, unknown or other
  modified_base (376)..(376): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtctgggggagatttggacagccaggggcggtccctgagactctctgtacaacctctggattcacttggnattangctatgagctggtccncaggctccgagggagggctggagtgggttgttcgnagagcaaagnttagtggtaggaacacccgagacttacgccgngtctgtgaaancagtattcaacaatctacaagagatgaattacccaaaagcatcgacctatctagacctaaaatcgaaactagacccgtagaaacgaccggaacggaccacgacggccgttagtaatttaccgtagttaccacggaacgtaccccgttacccgtaagttaacgttcggggaaccctttggtaccgttttacggaccgttacgggtccgggggaccgtaaacccggggg

SEQ ID NO: 440073 - DNA, 618 bp, Homo sapiens
  misc_feature: GZ8MTXP02J1OZX.21.75.G09.1.454.CMB.2.raw
  modified_base (209)..(209): a, c, t, g, unknown or other
  modified_base (277)..(277): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctggtggagtctggggganatttggtacagccagggcggtccctgagactctcctgtacaacctctggattcacctttggtgattangctatgagctcggtccgcaggcctccgaggggagggctgggaggttggggttggtttcgcgaggaagacaaagtattagtggtaggaacacccagattacgccgtcgtacgtgtgaaaacgacagtattacaactaaatctaccaaaggagatagtaacttaccgaaaaagctaagtccgtaccttatccgtagaactaaaatcgaaacacggcctaaggaaacgaccggaaggaccagacggtcccgtagtactttaacgacgtaccacgaactaccctaccgtagtaacgtcggggaacctgtacgttacggtacctacggtcggggacctaaccgggg

SEQ ID NO: 440074 - DNA, 700 bp, Homo sapiens
  misc_feature: GZ8MTXP02HLLHN.21.75.G09.1.454.CMB.2.raw
  modified_base (280)..(280): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggttttccttgttgcttaactttaaaaggtgtccaatgtgaggtgcagctgggtggagtcgtgggggagtagtttggtacagccgaggggccgtccctgagactctcctgtacaacctctggattcactttggtntattatgctatgagtcgttcggtcccgccgaggccgtaccggaggggaacggggtcgtgggtaggttggggtttggtttcgacgaaggtaaagacgtaaaagtattagtgggtacggaaacaaccccgaagtacgttaccggccgtcgttcgtaggtagaaaacgactaagtacttactaactaacttactacgaaagtaagtaatagtaacttaaccgaaaaacgctaacgtaccgtaccttactcgtacgaactaaagtacgaaacgacgtaccgtaacgaaacgaaccggaacggaacgacgacggtacgtacgttaacttactcggtacctacggtaactacccgttaccgtaacgttaacgtacggtaacgtcgttcgttacgacgttacggtaccggggaccggtaacccgggg

SEQ ID NO: 440075 - DNA, 668 bp, Homo sapiens
  misc_feature: GZ8MTXP02J2F1H.21.75.G09.1.454.CMB.2.raw
  modified_base (275)..(275): a, c, t, g, unknown or other
  modified_base (365)..(365): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtgggggagatttggtacagccgagggcggtccctgagactctcctgtacaacctctggattctacctttggngtattatgctatgagctggtccgcaggctccgaggggaagggcgtgggtaggttggggttggtttcgcgaaggaagacaaaagtattagnggggtacgaaacaccccgagtacttaccggccgtcgtcgtagtaggaaagtacagattccaataaactctaacaaagagtagtagaacttaaccgaaaagcaagtccgacctatcctagacctaaagtacggaacagacccgtagaaaccgaccggaaggaaccacgacggtaccgttaggtaactttacgtacgtaaccgtaccggtaaacgtaccccgttacccgtaaagttaacgtaccggggtaaccttacggtccgtttacggaaccgttccggtacgggggaccctaaacccggggg

SEQ ID NO: 440076 - DNA, 617 bp, Homo sapiens
  misc_feature: GZ8MTXP02I23LI.21.75.G09.1.454.CMB.2.raw
  modified_base (274)..(274): a, c, t, g, unknown or other
  modified_base (298)..(298): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggggagatttgggtacagccaggggcggtccctgagactctcctgtacaacctctggattcacctttggngtattatgctatgagctggttccnccaggcctccgaggggaaggggctgggaggttggggttggtttcgcgaggaagcaaaagtattagtgggtaggaacacccgagtacttacgccgtcgtctgtagaaagacagtattcaaacaaatctacaagaagatagattaccaaaagtccatccgacctatctagacaaatacgaacacgacctagaaacgaccggaggaccaacgcggtaccgtagttacttaacgtcgtactcggtaacgtacccgttacccgtaagtaagtacggtaaccgtgtacgtttacgaccgttaacggtcgggggacctaaccgggg

SEQ ID NO: 440077 - DNA, 661 bp, Homo sapiens
  misc_feature: GZ8MTXP02HQ19B.21.75.G09.1.454.CMB.2.raw
  modified_base (266)..(266): a, c, t, g, unknown or other
  modified_base (290)..(290): a, c, t, g, unknown or other
  modified_base (308)..(308): a, c, t, g, unknown or other
  modified_base (333)..(333): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggtttccttgttgctacttaaaggtgtccaatgtgaggtgcagctggtggagtcgtgggggagtagtttggtacagccagggcgtccctgagactctcctgtacacctctgattcactttgngtattatgctatgagtctggtccncaggctccgaggggaggntgggagtggttggtttcgcaagganacaagattagtggtagaacacccgagtactaccggccgtgttcgtagtaggaaaagacaagtacttacaaactaagttcctacgaaaggagtaagtacgtaacttaaacccaaaaagcctacgtacccgtacctagtctaggaactaaatacgtaacacgaccgtaggaaaaccgacggaacgaaccgaacgacgtaccgttagttaactttacgtacgttaaccgtccggtaacgtaaccccgttaccgtaaaacgttacgtacgggtaaccgttcggttacgttttaccgacgtttaccggtaccggggtaccggtaaacccgggg

SEQ ID NO: 440078 - DNA, 827 bp, Homo sapiens
  misc_feature: GZ8MTXP02HRKXD.21.75.G09.1.454.CMB.2.raw
  modified_base (276)..(276): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggatagtttggtacagccgagggcggtccctgagactctcctgtacacctctggattcaccgtttggngtattatgctatgagcttcggtcccgccaggcctccggaaggggaggggcgtggggtaggttggggtttggttttcggtacgaaggaaagacgtaaaagtatttaggtagggtaggaaaaccaccccgaagtaacgttacccggcccggtcgttcgtagggttaagaaaaggtaccaaagttacctttaaccaaactaaactttaccggaaacaaaaggaaaggtaagttaacgtaaaccgtttaaaacccaaaaaaacggtcctaaacgttacccggtaacccctttaatcgtaaacgtaacttaaaacgtaacggtaaaaccacggtaacccgtaaacggaaaacggaacccgggtaaacgggaaccaaccgtacgggtaacccgttagtttaaaccgtttaaacgttaccgttaaaccgtacccggtaaacccggtttaacccctaccccgttaaaagttaaccgggttacgggtaaccccgtttgttaaccggttttacgaaccggtttaccgggtacccgggggtaacccggttaaaccccggggg

SEQ ID NO: 440079 - DNA, 639 bp, Homo sapiens
  misc_feature: GZ8MTXP02HUJSS.21.75.G09.1.454.CMB.2.raw
  modified_base (295)..(295): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtgggggagtatttggtacagccgagggcggtccctgagactctcctgtacaacctctggattcactttgtgattatgctatgagctggtccncaggctccgagggagggctggaggtgggttgttcgcagaagacaaagattagtggtagaacacccgaagtacttaccgccgtcgtcgtggtagaaaagacaagtacttacaactaaattccactaaagagtatagtaacttaaaccaaaagcctaagtcccgaccttactctagaccaaaatacgaaacacgacctaaggaaaccgaccggaaggacacgagtaccgtagttaacttacgtacgttaccaccggtacgtaacccccgttaccgtaagttaacggtcgggtaacccttgtacgtttacgaaccgtttacgggacggggtacccgtaacccggggg

SEQ ID NO: 440080 - DNA, 837 bp, Homo sapiens
  misc_feature: GZ8MTXP02G2P5A.21.75.G09.1.454.CMB.2.raw
  modified_base (412)..(412): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagtattttgggtacaggcccgagggggccggtccctggacgactctcctgtaccaacctctggattcaccgtttggtgattatgctatgagtcgttcggtcccgaccgagggtcctacccggaagggggaacggggtcgttaggggaggtttcggggggttttggttttcccggtagaaagggtaaaacggactaaaaagggtntttaaaggtggggtaacggaaaccaaccccgtaaggtaccgtttaaccgggccccgtacgttccgttagggtaacggaaaacggtaccaaaggttaactttaccgaaaactaaaacgttcctaaacgaaaggtagtaagtagtaacttaaacccgaaaaagtctaacgtacccgtaccttaaactcgttaaggaacctaaaagtcgaaaacgacgtacccgtaaggaaaaccggaacccggaagggaaccaacgtaccggtacccgttagttaaacgtttaacccgtaggttaccctaacgggtaacccgttaaccccttaaccccggttaaaagttaacggttacccgggggtaacccttgggtttacccctttaggaaccggttttaacccggggacgggggtaaaccccgtaaacccggggg

SEQ ID NO: 440081 - DNA, 649 bp, Homo sapiens
  misc_feature: GZ8MTXP02J2OPQ.21.75.G09.1.454.CMB.2.raw
  modified_base (211)..(211): a, c, t, g, unknown or other
  modified_base (276)..(276): a, c, t, g, unknown or other
  modified_base (345)..(345): a, c, t, g, unknown or other
  modified_base (350)..(350): a, c, t, g, unknown or other
  modified_base (357)..(357): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttgggcttagctggggtttttcccttgttgctacttttaaaaggtgtccaatgtgaggtgcagctggtggagtctgggganatttggacaggccagggccgtccctgacgactctcctgtaaccactctaggtattctacttggtnattatgctagtgacgcgtggtccgccaggcctaccggagggacggggctggagttggggttgttcgtanagaancaaagtntagtggtcgaaccacccagtacttacgcccgtcgtacgtgtagaaaacgacgtagtacttcaacctatttcccagaaagtaggatacggaacttaacccgaaaaaggtccattcccgaaccttaacgtcttaagaacctaaaagtgaaaccgacgaccgttaagaccgaacccgaggacaacgacgtaccgtagttacttacgtcgtacctaacggaccgtaccctttacccggataacggtcggtaacctcgttacgtttacgacgtaccggtcgggacccgtaacccggg

SEQ ID NO: 440082 - DNA, 693 bp, Homo sapiens
  misc_feature: GZ8MTXP02HPFJ8.21.75.G09.1.454.CMB.2.raw
  modified_base (265)..(265): a, c, t, g, unknown or other
  modified_base (389)..(389): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggtttttccttgttgcttaacttttaaaaggtgtccaatgtgaggtgcagctgggtggagtcgtgggggagtagtttggtacagccgagggccggtcctgagactctcctgtacaacctntggtattctaccgtttggtgtattatgctatgagtcgttcggttccgccgaggcctaccggaaggggaacggggcgttggggaggtttggggtttggtttccgacgaaggaagacgtaaaagtnttaagtgggtaggaaccacccgaagtattaccggccgtcgtcgtagtagaaagaacagtacttacaaactaattctacgtaaagagtagtagtaacgttaacccgaaaagtcctaacgttacccgtaccttaacgttacgtaacgaacctaaagtacgaaaccgtacggaccctaaggaaccggaaccggaggaaccacgacggtccgttatacttacgtacgttactcgaacgtaccctaccgtaatacggtacggtaacctcggttacttacgaccgttacggacggggtaccctaacgggg

SEQ ID NO: 440083 - DNA, 700 bp, Homo sapiens
  misc_feature: GZ8MTXP02HTQ3U.21.75.G09.1.454.CMB.2.raw
tcagtcgtcgctcgcacgaccggtgctcgatttagtatagacatcaggggggagaggagccccagccgtgagattcccaggagtttccacttggtgatcagcactgaacacagaccaccaaccatggagttgggcttagctgggttttccttgttgctactttaaaggtgtccaatgtgaggtgcagctggtggagtcgtgggggagtagtttggacgagccgaggggtccggtcccgtgacgtaccttcctcctagtaccaaccttcgtggtacttcctaccgtttggtagtattatgctagtgagtcgttcggtcccgcgtaggccgtaccggaaggggaacggggtcgtgggtaggttggggtttcggtttacggacgtaaggaagtaacgaaaaggtattaagtagggtacggaaaccacccgtaaggtacttaccggccgtacgttcaggtacgaaagacagtacttacaacaagtcctacgtaaagagtactagtacttaaacccaaaagtctaactcccgtactactcgtagtaacaaaagtcgaaacacgaccgtagaacgaaccggaagaccacgaccgtcgtagttaacttacgcgttacgacgtaccgtaccgttaccgaagttaacggtcggtaacccgttgtaccgtttacggaaccgtttacggaccggggtacctaaacccgggg

SEQ ID NO: 440084 - DNA, 586 bp, Homo sapiens
  misc_feature: GZ8MTXP02JINFI.21.75.G09.1.454.CMB.2.raw
  modified_base (209)..(209): a, c, t, g, unknown or other
  modified_base (264)..(264): a, c, t, g, unknown or other
  modified_base (269)..(269): a, c, t, g, unknown or other
  modified_base (285)..(285): a, c, t, g, unknown or other
  modified_base (301)..(301): a, c, t, g, unknown or other
  modified_base (305)..(305): a, c, t, g, unknown or other
  modified_base (318)..(318): a, c, t, g, unknown or other
  modified_base (328)..(328): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtggggganatttggtacagccagggcgtcctgagctctctgtacacctctggattcacttggnattangctatgagctggtccncagctccgagggaggntggngtgggttgttcgnagagcaagtnttagtggtagaacacccgagtactacgccgtcgtctgtagaaagcagtacttcaacgtaatctacaagacgatagattaaccaaaagcaatccgtacctatctagactaaagtacgaacacgactacgaacgaccgagacacgacgaccgtagtaacttacgtacgtacgtcgaaccgtacccgttaccgtaacgtaacgtacgggtaacctcggttactttacgaccgttacggtaccggggaccgtaaacccgggg

SEQ ID NO: 440085 - DNA, 712 bp, Homo sapiens
  misc_feature: GZ8MTXP02GWYFF.21.75.G09.1.454.CMB.2.raw
  modified_base (275)..(275): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaaggtgtccaatgtgaggtgcagctgggtggagtcgtggggggatagtttggtacagccgaggggccggtccctgagactctcctgtacactctgattcactttggtnattatgctatgagtcgtcggttcccgccgaggcctaccggagggggaacggggcgtggggtagggttgggggttttggtttccgtacggaaggaaacgacgtaaaaggtatttaggtaggggtaacggaaaccaccctaaggtacttaccggccggtacgtcgttaggtaggaaaagtacaaggtacttaccaaactaaatcgtaaacaaaggacgtatacggtaacttaaacccaaaaaggtcctaagtcccgtaccttagttctaagaactaaaagtcaaacgcgtacgtaagaaacgaaccggaaggacaacgtacggtaccgttagttaactttacgtacggttacctacgaacgtaccccgttacgtaacgtaacgtacggtaaccttggtactttacggaccgttacggaccgggggtacctaacccgggg

SEQ ID NO: 440086 - DNA, 769 bp, Homo sapiens
  misc_feature: GZ8MTXP02JN769.21.75.G09.1.454.CMB.2.raw
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagatttggtacagccgagggcgtccctgagactctcctgtacaacctctggattcactttggtgattatgctatgagtcgtcggttcccgccgagggcctaccggaagggggaacggggtcgttaggggtaggttgggggttttcggttttcggtacgaaggtaaaaggacgaaaaaggttatttaaaggtggggtaaacgggaaaccaacccccgtaggtaaacgtttacccggcccggtacggttccttagggttacggaaaagtacgtaaggtactttaccgaaactaaacttctaaaccgaaaggtaacgtagtaggtaacttaaacccgtaaaaaacgccgtaaacgttacccggtaccccgtttaattacccgttagaaacctaaaagttacgaaaaccgaacggtacccgtaaggaaaaccggaacccggaaacggaaccaacggacgtacccggtagtaacgtttactacggtacgtaccgaacgtacccgtacccgtaattaccgtacggtaacctgtacttacgaacgttacggtcggaccggtaacccggg

SEQ ID NO: 440087 - DNA, 876 bp, Homo sapiens
  misc_feature: GZ8MTXP02HUI64.21.75.G09.1.454.CMB.2.raw
  modified_base (256)..(256): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggatatttggtacagccaggggcgtccctgagactctctgtacaacctcnggtattcacctttggtgattatgctatgacgtctcggttccgcgaggcctaccgaggggaagggcgtggaggttggggttggtttccgtacgaaggtaacgacgtaaaagtatttaagtgggtaaggaaaccaaccccgaggtaactttaccggcccgtcggttaccgtgggtagaaaacgtaaccgtagtaactttaccaaactaaaacttcccgtaaacaaaaggaagtaagttacggtaaaacctttaaacccccgaaaaaaggtcctaaaccgttaccccggaaccccttttaaagtaccgtaaacggtaaaacctaaaaggtaaccggaaaaccgtaccgggtaacccgtaaacgggaaaacccgggaaaccccgggaaacggggttaaacccgaaaacgggtacccggttaaccggtttaaacgtttaaaccgttttaaaccgttacggggtttaaaccccgtacccggtaaaacccggttaccccccgtttaaacccgggttaaaagggtttaaaccggttccccgggggtaaacctttaccggtttaaccggttttaacggaacccgggtttaaccccggggtaccggggggaaacccccgtaaacccgggg

SEQ ID NO: 440088 - DNA, 687 bp, Homo sapiens
  misc_feature: GZ8MTXP02HWS1F.21.75.G09.1.454.CMB.2.raw
  modified_base (375)..(375): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagcttgggttttccttgttgctaactttaaaggtgtccaatgtgaggtgcagctggtggagtcgtgggggagtattttggtacaggccgaggggccggtccctggagacttcctcctgtaaccacctctggtacttcgtaccttttgggtgtatttatgctatgagctggtcccgcgacggctccggaggggaaggggctgggaggttggggtttggtttcgtacgaaggaacganaaagtatttagtggggtagaaacctaccccgaggtacctttacggcccgtcgttcgttacgggtagaaacgactagtacttacacgtaaattcctacaaagagtaactagtaacttaaccgaaaaagtcctaagtcccgtaccttataccgtagtacaaaagtacgaaacgtacgacccttaggaaacgaccggaaggaaccaacgaggtccgtagttaattactcgtactaccgacgtacccgttaccgtaactaacgtacgggtaaccgtgtaccgtttagaccgtaccggtcgggacccgtaaccgggg

SEQ ID NO: 440089 - DNA, 777 bp, Homo sapiens
  misc_feature: GZ8MTXP02GL8TM.21.75.G09.1.454.CMB.2.raw
  modified_base (256)..(256): a, c, t, g, unknown or other
  modified_base (270)..(270): a, c, t, g, unknown or other
  modified_base (284)..(284): a, c, t, g, unknown or other
  modified_base (293)..(293): a, c, t, g, unknown or other
  modified_base (335)..(335): a, c, t, g, unknown or other
  modified_base (340)..(340): a, c, t, g, unknown or other
  modified_base (370)..(370): a, c, t, g, unknown or other
  modified_base (375)..(375): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttcctgttgctactttaaaggtgtccaatgtgaggtgcagctggtggagtcgtgggggatatttggtacagccgagggccggtccctgacgactctctgtacacctcngattcacgtttggngattatgctatgancgtggtccncgagctaccgagggaggctggagtggggttgttcgcagaganaagtnttagtggacgaacaccgagacttacgccgngtcgngtaggaaacacgagtacttaccaagtaactcctaagaagaagtagtaggtaaacttaacccgaaaaaggtcctaacgttcccggtaaccttacgtccgttaacggaaacctaaaaaggttccggtaaaaaccgaccgggttaaaccccgtaaagggaaaacccggtaacccgggaaacgggggtaacccaaaacccggtaccgggttaaccccggggtttattttaaaacccgtttaaccggttacccggtttaaaccgttaaccgggtaaaccgtttaaacccccgttaccccggttaaagttaaacgggttcccggggtaaaccgtttcgtttaacccggtttacggttaacccggttaaacggggttcccgggggaaaccccgtttaaaaccccggggg

SEQ ID NO: 440090 - DNA, 742 bp, Homo sapiens
  misc_feature: GZ8MTXP02F1VY7.21.75.G09.1.454.CMB.2.raw
  modified_base (271)..(271): a, c, t, g, unknown or other
  modified_base (276)..(276): a, c, t, g, unknown or other
  modified_base (284)..(284): a, c, t, g, unknown or other
  modified_base (326)..(326): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttggcttagctgggttttcctgttgctactttaaaggtgtccaatgtgaggtgcagctggtggagtcgtgggggagtagtttggtacagccgagggccgtccctgagactctcctgtacacctctgattctactttggtntattntgcttagngagcgtcggttaccgccacggcctaccggaggggtacggggngtaggggtaggtttgggtttggtttcggtacgtaaggaaacgtaactaaaaggttacgtttaaggtacggggttaaacggaaacctaaccccgtaacggtaaccgtttacccggggacccccgtcggttacgttagggtacggaaaacgtcgtaaacgtactttacaaacgtaaatcgtaacgaaaggaagtaagtaactaaccgttaaaccaaaacggctaaacgtccggtaacccttaagtccgttaaggaacctaaagtacgaacacggtacaggaacacgtaggacagtacgccgttaagtacttactacggtacctacgaccgttacccgttaaccgtaagttaaccggtagggtaacccttaggttacgtttacggacgttaaccgggtcgggaaccgtttaaacccggg

SEQ ID NO: 440091 - DNA, 653 bp, Homo sapiens
  misc_feature: GZ8MTXP02JF6LX.21.75.G09.1.454.CMB.2.raw
  modified_base (277)..(277): a, c, t, g, unknown or other
  modified_base (299)..(299): a, c, t, g, unknown or other
  modified_base (316)..(316): a, c, t, g, unknown or other
  modified_base (332)..(332): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggaggtcgtggggggagtagtttggtacaggccaggggccggtccctgagactctcctgtacacctctggattcactttggngattatgctatgagctggtccncaggctcgagggagggntggagtggttgttcgnagagcaaagtatagtggacggaacaccccgagtattacgccgtcgtctgtagaaacgacagtattacactaaatcctacaaagaagaatagtacttaacaaaaagcctaataccgtacctaactcgttagaacctaaatacggaaacacgacccgtaaggaaacgaaccggaacgggaccaacgtaacgtaccggtattaactttaccgacgttacgtaccgtaacgtaaccctttacccggtaaacttaacggtacggtaacccgttgttaaccgtttcggtaaccgttaccggttcgggggaccccggttaaaccgggg

SEQ ID NO: 440092 - DNA, 643 bp, Homo sapiens
  misc_feature: GZ8MTXP02GUHM8.21.75.G09.1.454.CMB.2.raw
  modified_base (185)..(185): a, c, t, g, unknown or other
  modified_base (262)..(262): a, c, t, g, unknown or other
  modified_base (268)..(268): a, c, t, g, unknown or other
  modified_base (284)..(284): a, c, t, g, unknown or other
  modified_base (328)..(328): a, c, t, g, unknown or other
  modified_base (333)..(333): a, c, t, g, unknown or other
  modified_base (609)..(609): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttcctgttgctactttaaaggtgtccaatgtgaggtncagctgggtggagtcgtgggggatatttggtacagccagggcgtccctgagctctctgtacactctgattcacttgngattangctatgagctggtccncaggcctcgagggaggctggagtggttgttcgcagagacaagtnttagnggtagacacccgagtactacgccgtcgtctagtacgaaagcaagtacttacaactatacctacgaaagagtagtagtaacttaacccgaaaaagctaacgtccgaccttaaagtccgttaacgaacctaaaagttcgaaaacgtaccgtaccgtaacggaaaccgaccggaacgggaactaacgtacggacccgttagtaactttaaccgcgttaacctccgtaacgtacccgttaccgtaacgtaaacggtcgggtaaccttcgttaccgtttanaccggtacggtcgggggtaacccgtaacccgggg

SEQ ID NO: 440093 - DNA, 738 bp, Homo sapiens
  misc_feature: GZ8MTXP02JU2NL.21.75.G09.1.454.CMB.2.raw
  modified_base (259)..(259): a, c, t, g, unknown or other
  modified_base (276)..(276): a, c, t, g, unknown or other
  modified_base (380)..(380): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctggtggagtcgtgggggagtagtttggtacagccgaggggccggtccctgacgactctcctgtacactntggtattctactttggngtattatgctagtgacgtcgttcggttcccgccgaggcctaccggaggggacggggcgtggggtaggttggggtttggtttcgtcgaaggaacgacgaaaggtnttaaggtggtaaggaaccaccgtagtacgttaccggccgtacgtcgttagggtacgaaaacgtagaacgtacttaccgaacgtaaacttccgtaaacgaaaggtaacgtaacgttagtaaacctttaaaacccgaaaacgtccctaagttacccgacctttaaacgtcgttaaacggaactaaaacgttcggaaaacctccgggacccgttaacgggaaaaccgacccggggaaggaaccgacgacgtaccggttagtaacttacgtacgttacgaccgaactccccttacggtagttaaccggtcggtaactcgttcgtttaccggacgtaccgggtacgggggacctaaaccgggg

SEQ ID NO: 440094 - DNA, 845 bp, Homo sapiens
  misc_feature: GZ8MTXP02ISYEB.21.75.G09.1.454.CMB.2.raw
  modified_base (241)..(241): a, c, t, g, unknown or other
  modified_base (294)..(294): a, c, t, g, unknown or other
tcagtcgtcgctcgcacgaccggtgctcgatttagtatagacatcagggggggagaggagccccagccgtgagattcccaggagtttccacttggtgatcagcactgaacacagaccaccaaccatggagtttgggcttagctgggttttccttgttgctactttaaaggtgtccaatgtgaggtgcagctgggtggagtcgtgggggagtagtttggtacaggccgaggggccggtcccngagactctcctgtacaacctctggtattctaccgtttggtgtattatcccgtntatgacgtcgttcgggttcccgccgacggtcctaccggagggggaaggggtcgtggggtaggttggggtttcgggtttcgtacgaaggtaagacgaaaagtattaagtgggtacggaaaaccaccccgtaagtacgttacccggcccggtcgttaccgtaggttaggaaaacgtaaccgtaaaggtactttaccaaacgtaaattccctaaacgaaaggtaagtaagttacgtaaactttaaacccgaaaaaacgtccgtaaacgttacccggtaccccttaagttaccgtaacgtaaacctaaaagttaacgaaaaccgaccggtaccgtaaacgggaaaaccggaacccgggaaacgggaacccgtaacgtaaccgggtacccgttaagttaacgttttaaaccggtacgttaacccgtaaccggtaaccggttaaaccccgttacccggttaaacgttaaacggttccggggtaacccttacggttaccgttttacggaacccgtttacccgggggtaccgggggtaaccccggtaaaaccccggggg

SEQ ID NO: 440095 - DNA, 621 bp, Homo sapiens
  misc_feature: GZ8MTXP02FHNGH.21.75.G09.1.454.CMB.2.raw
  modified_base (274)..(274): a, c, t, g, unknown or other
  modified_base (361)..(361): a, c, t, g, unknown or other
tcagtcgtcgctcgcacgaccggtgctcgatttagtatagacatcaggggggggagaggagccccagccgtgagattcccaggagtttccacttggtgatcagcactgaacacagaccaccaaccatggagtttgggcttagcttgggttttccttgttgcttactttaaaggtgtccaatgtgaggtgcagctgggtggagtcgtgggggatatttggtacagccgaggggccggtccctgagactctcctgtacactctgattcactttggntatatgctatgagtcgtcggtccgcaggctcggaggggagggcgtggaggttggggtttggttcgtcgaagaagacaaagtattagngggtacgaacacccgagactacgccgtcgtctggtagaaagacagtactcgaactaatctagaagagtatagtacttaacgaaaacgctaactccgtcctatctacgacaaaagtacgaaacgcgaccgtaagaaaccggaacgacgacacgacggtccttagtacttacgtagtaccgtaccgaacttacccgtaaccgttaataacggtacggtaaccgtacgttcgtttacgacgtaccggcgggaccgtaaccggg

SEQ ID NO: 440096 - DNA, 620 bp, Homo sapiens
  misc_feature: GZ8MTXP02FVQQE.21.75.G09.1.454.CMB.2.raw
  modified_base (166)..(166): a, c, t, g, unknown or other
  modified_base (204)..(204): a, c, t, g, unknown or other
  modified_base (235)..(235): a, c, t, g, unknown or other
  modified_base (429)..(429): a, c, t, g, unknown or other
tcagtcgtcgctcgcacgaccggtgctcgatttagtatagacatcaggggggagaggagccccagccgtgagattcccaggagtttccacttggtgatcagcactgaacacagaccaccaaccatggagtttggcttagctgggtttcctgttgctacttaaaggngtccaatgtgagtgcagctggttggagtcgtggggganatttggtacagccagggcgtcctgagacctntcctgtaacaacctctggattcacctttggtgacttatgctatgagctaggttccgcaggctccgagggagggactggtaggtcgggtttggttacgtcgagtaacgctaaagatttatgggtaggaaccacccgagaattacgccgcgtctagttcgaaacgagagtacttgaactaaatcgtacaaggtaanataggtaacttaccaaaaggcaaattcgaccctatactagaccaaagttcaaacaacggtaaccagaaacgaccggtaagacgaccgaagcccgtaagtattaacgtcggtacttacggactaccgtacccgtaacgtaagtcgggaacccttgcggttacgtacgttaaacgttcgggccggtaaaccgg

SEQ ID NO: 440097 - DNA, 523 bp, Homo sapiens
  misc_feature: GZ8MTXP01C44B2.45.26.C04.1.454.CMB.2.raw
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtctcggtgaggatctcttgcaaggcctctggagactccttcagaaccgattctatcagttgggtgcgacaggcccctggacaaggacttgagtggatgggaagatgctttctatctttaatacaagagacctacgcacagatcttccnggcagactctccattaccgcgacgagtccacgagtacagcctacatgatctgaccagcctcacatctgaagcacgtccgtttatactgtcgcggggtaattcttcgtacttactttgacttagttgggccaaggggaccctggtcacgttctccttcgccg

SEQ ID NO: 440098 - DNA, 603 bp, Homo sapiens
  misc_feature: GZ8MTXP01EU2QK.45.26.C04.1.454.CMB.2.raw
  modified_base (419)..(419): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctctgtgaggatctcttgcaaggcctctggagactccttcagaaccgattctatcagttggtgcgacacggcccctggacaaggcttgagtggagtgggaagatgcttctattacttaatacaagacgactacgacacagaactctccgagggcagactctaccattacccgacgacgacgtccaacgagtacgacgcctaanagtggactctagaacccaggccctacactactctaagaacgacgtaccggtccgtttaattaccgtggtgggtcggggttacgtttccgttacgttaacttacgtttcggaaccgttcgggttacgggggtcccgtacgggggtccccttacggggtccttacccggttccttcccgtaacccg

SEQ ID NO: 440099 - DNA, 542 bp, Homo sapiens
  misc_feature: GZ8MTXP01EGMJH.45.26.C04.1.454.CMB.2.raw
  modified_base (336)..(336): a, c, t, g, unknown or other
  modified_base (363)..(363): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccactcccaggtccagctggtgcagtctggggctgaggtgaggaagcctgggtcctcggtgaggatctcttgcaaggcctctggagactccttcagaaccgattctatcagttgggtgcgacaggcccctggacaaggcttgagtggatgggaagatgctttcctatctttaanacaagagacctacgcacagatcttccngggcagactctccattaccgcggacagtccacgagtacagacctacatggatctgaaccagcctacactatacctagaaagacacggtccgtttaattacgtgtggcggggtaatttcttcgtacttacttgacttacgttggggccaaggggccctggtccacgttctccttcgaacg

SEQ ID NO: 440100 - DNA, 609 bp, Homo sapiens
  misc_feature: GZ8MTXP01DRA4V.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctggtgaggatctcttgcaaggcctcgtggagactccttcagaaccgattctatcgagttgggtgcgacaggcccctggacaaggacttgagtggagtgggaaggatgctttcctattctttaaatacaagagacctacgcacagatcttccaagggcagactctccattaccgcgacgagtccacgagtaccagcctacatggatctacgaccagccctcaacctatccgtagaaacgaccgacggtacccgttttattactggtcggcgggggtaatttccgttacggttaacctttacgtttcgaaccgttaccggttcgggggacccgtaaccgggggtacccccgtttggggtaccctaccccggttccttccccgttcgtaaccccgg

SEQ ID NO: 440101 - DNA, 537 bp, Homo sapiens
  misc_feature: GZ8MTXP01C9J4B.45.26.C04.1.454.CMB.2.raw
  modified_base (355)..(355): a, c, t, g, unknown or other
  modified_base (363)..(363): a, c, t, g, unknown or other
  modified_base (403)..(403): a, c, t, g, unknown or other
  modified_base (410)..(410): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggacttgagtggagtgggaaggatgctttctatctttaatacaagagacctacgcanagatctcnggcagactctcatcgcgacgagtccagagtacagcctacntgatctnaccagcctcacatcctagaacgacacggtacctttatacgttggtgcgggggtaatttcgttcgtacttacgtttgacttacgttggggccctaaggggccctggtccaccgttctccgcgtaaccg

SEQ ID NO: 440102 - DNA, 601 bp, Homo sapiens
  misc_feature: GZ8MTXP01EAQOD.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctggtgagatctcttgcaaggcctctggagactccttcagaacccgtattctatcagttggtgcgacaggcccctggacaggacttgagtggatgggaagatgctttctattactttaatacaagagacctacgacacagataccttcgaagggcagacctctaccacgttaccggcgacgacgtaccacggagtaccgagacctacattggactctcgaccagccttcaactatactagaaagtacctacggttaccgtttataccgtggtcggtacgggggtctttcgttacgtacctttagtttcgaacgttacggttcgggggttacccgtaacgggggtacccgttcggtaccgtacccggttcttcccgttcgtaacccg

SEQ ID NO: 440103 - DNA, 566 bp, Homo sapiens
  misc_feature: GZ8MTXP01BX0UN.45.26.C04.1.454.CMB.2.raw
  modified_base (280)..(280): a, c, t, g, unknown or other
  modified_base (335)..(335): a, c, t, g, unknown or other
  modified_base (342)..(342): a, c, t, g, unknown or other
  modified_base (350)..(350): a, c, t, g, unknown or other
  modified_base (354)..(354): a, c, t, g, unknown or other
  modified_base (361)..(361): a, c, t, g, unknown or other
  modified_base (408)..(408): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtncgacaggcccctggacaaggcttgagtggatgggaagatgcttctatactttaanacaaganacctacgnacanatctccngggcagactctaccattaccgcgacgagtccacgagtacagccctanatgatctagaccagcctacacatctagaacgacacggtccttttaatcgtggtggtcgggggtaatttccgttgttaccttacgttttcgaacttacggttcggggcccgtaacgggggtaccctcgggtcctacccggttcctcccgttcgaacccg

SEQ ID NO: 440104 - DNA, 578 bp, Homo sapiens
  misc_feature: GZ8MTXP01EZ3W8.45.26.C04.1.454.CMB.2.raw
  modified_base (263)..(263): a, c, t, g, unknown or other
  modified_base (277)..(277): a, c, t, g, unknown or other
  modified_base (317)..(317): a, c, t, g, unknown or other
  modified_base (334)..(334): a, c, t, g, unknown or other
  modified_base (349)..(349): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctctggagactccttcagaaccgnttctatcagttggngcgacacggcccctggacaaggcttgagtggatgggaagntgctttctattcttaanacaagagacctacgnacagactcttcaagggcagactctccattaccgcggacgacgtaccacgagtacacgacctaacatacgggatctcgaacccacgcctacacactcgtagaacgacacggtaccgtttatacgtgtcggtcggggtaatttccgttacgtactttacgttcgtacgttacggttcggggaccggtaacggggtcccgtggtcccgtaccggttccctcgttccgaaccg

SEQ ID NO: 440105 - DNA, 571 bp, Homo sapiens
  misc_feature: GZ8MTXP01C03QO.45.26.C04.1.454.CMB.2.raw
  modified_base (266)..(266): a, c, t, g, unknown or other
  modified_base (280)..(280): a, c, t, g, unknown or other
  modified_base (318)..(318): a, c, t, g, unknown or other
  modified_base (371)..(371): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcgggtgaggatctcttgcaaggcctctggagactccttacagaaccgnttcatcagttggtncgacaggcccctggacaaggacttgagtggatggaagntgcttctattcttaatacagagacctacgcacagatcttcaagggcagactcnccattaccgcggacagtccagagtacacgacctacatggatctacgaccagcctacacatctagaacgaccgtacggtacctttagtaccgtggtcggtcgggggtaactttcgttccgttacttacgttttcgacttaacggttcggggaccgtaacgggggtaccctgggtcccacccggttctcccttcgtaacccg

SEQ ID NO: 440106 - DNA, 732 bp, Homo sapiens
  misc_feature: GZ8MTXP01EGQ15.45.26.C04.1.454.CMB.2.raw
  modified_base (366)..(366): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttggtgcgacaggcccctggacaggacttgagtggatggaagatgcttctatctttaatacaagagacctacgacacagtactaccttaccgngggtcacgaccttcctaccctaacgtttaacccggcgggtaacgacggttaccccaacgggtaaacgttaccgaacggtaccccgttaaacgtaacgttacggtaacttaccgtaccggaaacccgtaccgtacccgttacctaactaacgttaccgtaaggaaacccgtaaccgttaacccgggtttaaccgtttttaacgttaccgttaggggttaccggggttcgggggttaacgttttccggtttaccgtttaaccgtttaacgtttacggtaaccgttaccggggttcgggggttacccggtaaccgggggtaccccgttcgggttacccgtacccggttcccttcccgttccgtaacccg

SEQ ID NO: 440107 - DNA, 545 bp, Homo sapiens
  misc_feature: GZ8MTXP01BA46G.45.26.C04.1.454.CMB.2.raw
  modified_base (336)..(336): a, c, t, g, unknown or other
  modified_base (409)..(409): a, c, t, g, unknown or other
  modified_base (431)..(431): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggacttgagtggatgggagatgcttcctatctttaaanacaagagacctacgcacagactcttccaagggcagactctccattaccgcgacgagtccagagtacagcctanatggatctgaccagcctcaccntcctagaacgcaccggtcgtttatacctggtcggcggggtaattcttcgtacttcgtttcgacttacgttggggccaagggggcccctgggtccaccggttctccttcgaaccg

SEQ ID NO: 440108 - DNA, 571 bp, Homo sapiens
  misc_feature: GZ8MTXP01D6N3U.45.26.C04.1.454.CMB.2.raw
  modified_base (263)..(263): a, c, t, g, unknown or other
  modified_base (279)..(279): a, c, t, g, unknown or other
  modified_base (315)..(315): a, c, t, g, unknown or other
  modified_base (330)..(330): a, c, t, g, unknown or other
  modified_base (332)..(332): a, c, t, g, unknown or other
  modified_base (334)..(334): a, c, t, g, unknown or other
  modified_base (336)..(336): a, c, t, g, unknown or other
  modified_base (342)..(342): a, c, t, g, unknown or other
  modified_base (344)..(344): a, c, t, g, unknown or other
  modified_base (346)..(346): a, c, t, g, unknown or other
  modified_base (355)..(355): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctctggagactccttcagaaccgnttctatcagttgggtncgacaggcccctggacaaggcttgagtgatggaagntgcttctatcttaananananacacanananactctacgngcagactctacacgtacgcgacgactacagacgtacacgacctacagtcgactcgacgaccacgcctacactactacgaacgaacgtaccgtaccggttactttagtacgtggtcgggcgggttaactttcgttacgttacttacgttacgtacgttacggttcggggaccgtaacggggtccctcggtccctacccgttcctcccgttcgaaccg

SEQ ID NO: 440109 - DNA, 599 bp, Homo sapiens
  misc_feature: GZ8MTXP01A4D4N.45.26.C04.1.454.CMB.2.raw
  modified_base (341)..(341): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcaggttggtgcgacaggcccctggacaaggacttgagtggatgggaagatgcttctatcttaatacaaganaccctacgcacagatacttcaagggcagactctccattaccgcggtacgagtccacgagtacagcctacatggactctgacccagccctcacatcctagaaacgaccgtaccggtaccgttttaataccgtggtcggcgggggttaatttctttcggttaacttaccgtttacggtaaccgttacggttcgggggaccccggtaagggggtaccccttcggggtaccctacccgggttccgttcccttccgaaccccg

SEQ ID NO: 440110 - DNA, 559 bp, Homo sapiens
  misc_feature: GZ8MTXP01AM1ZA.45.26.C04.1.454.CMB.2.raw
  modified_base (316)..(316): a, c, t, g, unknown or other
  modified_base (333)..(333): a, c, t, g, unknown or other
  modified_base (348)..(348): a, c, t, g, unknown or other
  modified_base (361)..(361): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttggtgcgacaggcccctggacaaggcttgagtggatggaagntgcttcctattcttaanacaagacgactacgnacagactctccgnggcagactctcatacgcgacgactccagctacagacctacatggatctagaccacgccctacactatcctagaacgacgacggtacctttataccgtgtcggcggggtaatttcgttcgtacttcgtttacgacgttacggttcggggttaccgaacgggggtccctaacgggtccaccggttctaacccttcgcccg

SEQ ID NO: 440111 - DNA, 629 bp, Homo sapiens
  misc_feature: GZ8MTXP01BPH0T.45.26.C04.1.454.CMB.2.raw
  modified_base (322)..(322): a, c, t, g, unknown or other
  modified_base (339)..(339): a, c, t, g, unknown or other
  modified_base (346)..(346): a, c, t, g, unknown or other
  modified_base (357)..(357): a, c, t, g, unknown or other
  modified_base (372)..(372): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgtggagacttccttcagaacccgtattctatcaggttggtgcgacacggcccctggacaaggcttgagtggatgggaagntgcttctattacttaanacaaganacctacgcaanagtactccttaccgngggcacgtacctcctacctacgttaccggcggacgacgtccgaacgagtacacgtacctaacgagtacggacttcgacgaaccctacgtaccctacaactactacgtaagaaacgaccgtacggttacccgttttagtaccgttggttcgggcggggttaatttccgttcgttaacctttcgtttacggtacgttacggttcggggaccgtaacggggtccctaacggtccacccggttcctcccgttcgaaccccg

SEQ ID NO: 440112 - DNA, 694 bp, Homo sapiens
  misc_feature: GZ8MTXP01DZQPP.45.26.C04.1.454.CMB.2.raw
  modified_base (249)..(249): a, c, t, g, unknown or other
  modified_base (281)..(281): a, c, t, g, unknown or other
  modified_base (317)..(317): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagccgtgggtcctcggtgaggatctcttgcaaggcctcgtgganactccttacagaacctattctatcaggttggngcgacaggccctggacagactgagtggatgggaagntgtcttcctattcttaaatacaagagtacctacgacacagtactacttccgaagggcagacctctaccacgttaccgacggacgacgtaccaacggagtaaccagtacccgtactagtacggacttaccgtcgaaccgaaccgacccgttacaaacctaacttaccgtacggaaaaccgtaccggtaaccgggtttacccgttttaaacgttaaccgttcgggttacggggtccgggggtttaacttttccggtttaaccgggttaacctttaacggttttacgtaacccggttaacggttccgggggaccccggtaacgggggtaccccgttccggggtacctaccccggggttccctccccttccgtaaccccgg

SEQ ID NO: 440113 - DNA, 746 bp, Homo sapiens
  misc_feature: GZ8MTXP01D5EZZ.45.26.C04.1.454.CMB.2.raw
  modified_base (327)..(327): a, c, t, g, unknown or other
  modified_base (348)..(348): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgtggagacctccttacagaaccgattctatcaggttgggtgcgaacacggccccctaggacaaggactggagtggagtgggaagntgtctttctattacgtttaanacaagactacctacgacacgagtactccttacgaagggacaacgtaccttacctaccctaagttacccgggacgggtaacgacgtacccgaacggtaacgtaaccgacgtaaccctaagacgttacgggacttaccgtacggaaccctaccggtccctaactaaccgtacttaccgtaaacggaaacgtacccggttaaccggttaacccggtttttaagttaccggttcggggttacggggtccgggggtttaacttttaccggtttacccggttaacctttttaccgtttacggtaacccggttaaccggggtttccgggggacccggttaacccggggggttaccccttccgggttaccctaccccggttccgttaacccgcccgttaaccccgg

SEQ ID NO: 440114 - DNA, 576 bp, Homo sapiens
  misc_feature: GZ8MTXP01CX27O.45.26.C04.1.454.CMB.2.raw
  modified_base (281)..(281): a, c, t, g, unknown or other
  modified_base (321)..(321): a, c, t, g, unknown or other
  modified_base (338)..(338): a, c, t, g, unknown or other
  modified_base (365)..(365): a, c, t, g, unknown or other
  modified_base (474)..(474): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagcctgggtcctggtgaggatctcttgcaaggcctcgtggagactccttacagaaccgattctatcagttgggtncgacaggcccctggacaggacttgagtggagtgggaaagntgctttcattctttaanacaagagacctacgcacagactctacngggcagactccacagtacgcgacacgtaccacgagtacagacctacatggattcacgaccagtcctcaacctatccgtagaacgaacacgggttacctttataccgtgngggtcgggtaacttcttacggttacttcgtttacgaacttacggttcgggggacccgttaacgggggacccttcgggtccaccggttctcccttcgaacccg

SEQ ID NO: 440115 - DNA, 563 bp, Homo sapiens
  misc_feature: GZ8MTXP01B4DPJ.45.26.C04.1.454.CMB.2.raw
  modified_base (265)..(265): a, c, t, g, unknown or other
  modified_base (346)..(346): a, c, t, g, unknown or other
  modified_base (428)..(428): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaagggcctctggagactccttcagaaccgnttctatcagttggtgcgacaggcccctggacaaggacttgagtggatcgggaaggatgctttcctattctttaatacaagngacctacgcacagatacttccaagggtcagactctcctattaccgcggacgagtccacgagtacacgactacatggattcgngaccacgcctcacatcctagaacgacacgggtcctttatacctggtggcgggggtaatttcttacgtacttacgtttgacttacgttcggggcccaagggggtaccctgttaccgccgttctccgttcgtaaccg

SEQ ID NO: 440116 - DNA, 575 bp, Homo sapiens
  misc_feature: GZ8MTXP01DIUMK.45.26.C04.1.454.CMB.2.raw
  modified_base (314)..(314): a, c, t, g, unknown or other
  modified_base (364)..(364): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagcctgggtcctggtgaggatctcttgcaaggcctcgtggagactccttcagaccgattctatcagttggtgcgacaggcccctggacaggactgagtggatggaagntgctttctatctttaatacaagacgtacctacgacacagactaccttccngggcagacctcctacccacttacccggacggacgacgtccaacgacgtacacgtacctacagtggactctgaccacgcctacactatcgtagaacgctacggtaccgtttatacgtgtcggcggggttaattcttacgtacttacgtttcggacttacggttcgggaccgtaagggggtaccctcggtcctaccgttctccttcgaacccg

SEQ ID NO: 440117 - DNA, 547 bp, Homo sapiens
  misc_feature: GZ8MTXP01EU4DX.45.26.C04.1.454.CMB.2.raw
  modified_base (317)..(317): a, c, t, g, unknown or other
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctggtgaggatctcttgcaaggcctctggagactccttcagaaccgattctatcagttgggtgcgacaggcccctggacaaggcttgagtggatgggaagntgcttctatctttaatacaagagacctacgcacagactcttccgngggcagactctaccattaccgcgacgagtccacgagtacagacctacatggatctgaccagcctacacatctagaacgctacggtacctttatactgtggcgggtaatttcgttcgtacttcgtttgacgttacgttcggggcctaagggggaccccttgggtccaccgttctccgttcgaaccg

SEQ ID NO: 440118 - DNA, 541 bp, Homo sapiens
  misc_feature: GZ8MTXP01DKHCY.45.26.C04.1.454.CMB.2.raw
  modified_base (362)..(362): a, c, t, g, unknown or other
  modified_base (405)..(405): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcgttgaggatctcttgcaaggcctctggagactccttcagaaccgattctatcagttgggtgcgacaggcccctggacaaggacttgagtggatggaagatgcttcctatctttaaatacaagagacctacgcacagatcttcngggcagactctccattaccgcgacgagtccagatacagcctanatggatctgaccagcctcacatctagaagacacggtcctttattactggtcgcggggtaattcttcgttacttacgttttgaacttacgttcggggcctaagggggtaccctggtccaccgttctccgttcgaacg

SEQ ID NO: 440119 - DNA, 603 bp, Homo sapiens
  misc_feature: GZ8MTXP01DHJIG.45.26.C04.1.454.CMB.2.raw
  modified_base (285)..(285): a, c, t, g, unknown or other
  modified_base (324)..(324): a, c, t, g, unknown or other
  modified_base (344)..(344): a, c, t, g, unknown or other
  modified_base (370)..(370): a, c, t, g, unknown or other
  modified_base (416)..(416): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgtggagactcccttacagaacccgtattctatcaggttgggtncgacacggcccctggacaaggcttgagtggatgggaagntgtctttctattactttaanacaagagacctacgcacagatcttcngggcagacctcaccattaccggcgacgagtccagagtacagcctantggatctacgacctacgcctacactatctagaacgacgtacgggtacctttagttaccgtggtcggcgggggttaactttccgtttacgttaccgttacgtttacggaccttaacgggttcgggggacccgtaacgggggtaccccttcggggtcctaccccggttctaaccccgttcgtaaccccg

SEQ ID NO: 440120 - DNA, 628 bp, Homo sapiens
  misc_feature: GZ8MTXP01AMSW5.45.26.C04.1.454.CMB.2.raw
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaaggcttgagtggatgggagatgcttctatctttaatacaagagacctacgcacagatcttccgnggcagactcgtaccattaccgcgacgagtaccacgacgtacacgacctacatcggatccgtagacccagccctacaactatcgtagaaacgaccgtaccggttacccgttttaattaccgtgggtcgggtccgggggttaattttcccgtttacggttaacctttaccgttttaggtaacccgtttaccgggttcgggggttaccccggtaacgggggtcccccttgggtacccgtacccggttccttccccgttccgaaccccgg

SEQ ID NO: 440121 - DNA, 606 bp, Homo sapiens
  misc_feature: GZ8MTXP01CVDBN.45.26.C04.1.454.CMB.2.raw
  modified_base (327)..(327): a, c, t, g, unknown or other
  modified_base (342)..(342): a, c, t, g, unknown or other
  modified_base (358)..(358): a, c, t, g, unknown or other
  modified_base (370)..(370): a, c, t, g, unknown or other
  modified_base (380)..(380): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctggtgaggatctcttgcaaggcctcgtggagactccttcagaacccgtattctatcgagttgggtgcgacgacggcccctaggacaaggacttgagtggatgggaagntgcttctatcttaanacaagagactacgcanagactactacgnggcagactcncactaccgcgacagtaccagagtacacgacctacagtacggatcgtacgacccagcccttacaactactcgtagaaacgtaccgaccggttaccgtttaagtaccgtggtacggtcgggggttaatttccgttacggttaccttacgtttacgacgttacgggttcggggacccgtaacgggggtacccctgggtcccctacggttccctccgttaaccgaacccg

SEQ ID NO: 440122 - DNA, 674 bp, Homo sapiens
  misc_feature: GZ8MTXP01CNELC.45.26.C04.1.454.CMB.2.raw
  modified_base (350)..(350): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctctggagactccttcagaaccgtattctatcaggttgggtgcgacgacggcccctaggacaaggtcttggagtggagtagggaagatcgtctttactattacttaaanacaagacgaaccctacgacaacgtagactacccttaccgaagggcaacgaccgttcctaccgaacgttaacccgggccggtaacgacgtacccgaacggtagtaaccgagtacccctaagagtcggtactactacggaacctacggcccgttacaaacgtactaccgaagaaaccgtaccgtaccgggttaccctttaagttaccgtgggtcggtcgggggtaactttcgttaccggttaaccttacgtttacgacgttacgggttcggggacccgtaacggggtaccctgggtaccctaccggttcctcccgttcgtaacccg

SEQ ID NO: 440123 - DNA, 683 bp, Homo sapiens
  misc_feature: GZ8MTXP01CIJGA.45.26.C04.1.454.CMB.2.raw
  modified_base (286)..(286): a, c, t, g, unknown or other
  modified_base (336)..(336): a, c, t, g, unknown or other
  modified_base (359)..(359): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagcctgggtcctggtgagatctcttgcaaggcctgtggagtacctccttacagtaaccgtattactatcgaggttgggngcgaacgacggccccctaggacaaggacttggagtggagtagggaaagtntgtctttaccgtattactttaanacaaagactacctacgacacaagtactccttacgaagggcaagaccttcctacctacgttaccgacggaccgacgtacccgaacgaacgtaccaacgtacctaacgagtacggactcgtacgaaccctacggtacctaccaactattccgtaaagaacgacccgtaacggttacccgtttagtaccgttggttacgggtcggggttaacttttcgttaccggtttacttaccggtttacgtaaccgttacgggttccggggacccgttaaccgggggtcccctttgggtaccccgtccggttccttccccggttctaaccccgg

SEQ ID NO: 440124 - DNA, 717 bp, Homo sapiens
  misc_feature: GZ8MTXP01CRIIA.45.26.C04.1.454.CMB.2.raw
  modified_base (136)..(136): a, c, t, g, unknown or other
  modified_base (339)..(339): a, c, t, g, unknown or other
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctntttgtggtggcagcagctacaggtgtccagtcccaggtccagctggtgcagtcgtggggctggaggtggaggaagccgtgggtctcggtgaggatctcttgcaaggcctcgtggagtacctccttacacgaacccgtattctatcgaggttgggtcgcgaacgacggcccctggacaaggacttggagtggagtagggaagtntgtctttacctattactttaaanaactaagacgtacctacgacacagtacttcccttacccgaaggggaccctaacggtaacccttacctacccgtaacgttaaccccgggaccgggtaaccgtaacgtaccccgaacggaacgttaacccgaacgacccttaaacgagtacgggacttaccgtacgaaacccgtacgccctacaacgtactaccgtaaggaaacgtacccgtaacggttaccgttttaacgtccggttaggttcgggtacggggttaacttttcgttacggtttaccttcgtttacgaacgttaccgggttcggggacccgtaacggggtaccctcgggtcccaccgttcctcccgttcgtaacccg

SEQ ID NO: 440125 - DNA, 564 bp, Homo sapiens
  misc_feature: GZ8MTXP01ANEM8.45.26.C04.1.454.CMB.2.raw
  modified_base (317)..(317): a, c, t, g, unknown or other
  modified_base (333)..(333): a, c, t, g, unknown or other
  modified_base (361)..(361): a, c, t, g, unknown or other
  modified_base (545)..(545): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctggtgaggatctcttgcaaggcctcgtggagactccttcagaaccgattctatcgagttggtgcgacaggcccctggacaaggcttgagtggatgggaagntgcttctatctttaanacaagagacctacgcacagatactccgnggcagactctacacgttaccgcgacagtccacgagtacacgtcctacagttggacttcacgaccacgccgtcactactcgtagaacgacctacgggtcctttaagtctaggtcgcggggtaacttcgttcgtacttacgtttcgacttcggttcgggccgtaacggggtacccctgggtacccnccgttctccttcgaacccg

SEQ ID NO: 440126 - DNA, 714 bp, Homo sapiens
  misc_feature: GZ8MTXP01BJKPP.45.26.C04.1.454.CMB.2.raw
  modified_base (270)..(270): a, c, t, g, unknown or other
  modified_base (363)..(363): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagcctgggtcctggtgaggatctcttgcaaggcctgtggactacctccttacagtaacccgtnttctatcgaggttgggtgccgacgacggccccctaggaacaaggtcttggagtggagtaggggaagatcgtcctttaccttattactttaaanaacgaaaggactaaccctacggcaacgagtactaccgttacccgaagggaccacggtaccctctaccctacgttacccggacggacgtacgtacccgaacggacgtaccgacgtacccctaacgagttacgggacttccgtaacggaaccctaccggtccctactaactacgtaccgtacggaaaccgtcccggtaaccggtttacccgttttaaacgttccggttagggtccgggtaccggggttaacttttccgttacgttacctttacgttacggaaccgttcgggttccggggaccgtaaccggggtccctcgggtcccgtacccttcctcccgttccgaaccccgg

SEQ ID NO: 440127 - DNA, 612 bp, Homo sapiens
  misc_feature: GZ8MTXP01BAULX.45.26.C04.1.454.CMB.2.raw
  modified_base (317)..(317): a, c, t, g, unknown or other
  modified_base (333)..(333): a, c, t, g, unknown or other
  modified_base (412)..(412): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttggtgcgacaggcccctggacaaggcttgagtggatgggaagntgcttctatctttaanacaagagacctacgctacagtactcttccaagggcagactctaccattaccgcgacgagtccacgagtacagaccctanactggatcgtagaaccacgcctacaactactaccgtagaaacgccgtaacgggtaccttttagtaccgtggtcggcggggtaactttccgttcggtaacctttacgtttacggaacgttaccgggttcgggggttaccgtaacggggggtaccccttcgggtaccctacccgggttccttaacccgttccgtaaccccgg

SEQ ID NO: 440128 - DNA, 559 bp, Homo sapiens
  misc_feature: GZ8MTXP01END42.45.26.C04.1.454.CMB.2.raw
  modified_base (255)..(255): a, c, t, g, unknown or other
  modified_base (280)..(280): a, c, t, g, unknown or other
  modified_base (318)..(318): a, c, t, g, unknown or other
  modified_base (333)..(333): a, c, t, g, unknown or other
  modified_base (346)..(346): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctggtgaggatctcttgcaaggcctctggagactccttnagaacccgattctatcagttgggtncgacaggcccctggacaaggacttgagtggatggaagntgcttctatcttaanacaagacactacnacagatccttccaagggcagactctaccgtattaccggcggtacgagtaccgagacgtacagacctacagtggacttcacgacacgacctacacatctagaacgactacggtacctttattactgtggtcggggtaattcgttcgtacttacgttgtacttacgttcggggacctaagggggtccctggtcacccggttctcccttcgtcccg

SEQ ID NO: 440129 - DNA, 644 bp, Homo sapiens
  misc_feature: GZ8MTXP01EXI65.45.26.C04.1.454.CMB.2.raw
  modified_base (353)..(353): a, c, t, g, unknown or other
  modified_base (375)..(375): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctcggtgaggatctcttgacgaaggcctcgtggacgtaccttccttacgaacgaacccgtattctatcgaggttgggtcgacgacgaccggccccgtaggaacgaaggtacgttaggagtggataggaagaagtntcgtctttactattactttaanaacgaagacgactacgacacagtaactctcgagcagtactactactacgtacccggcgaacgtaccgtaccgaacgtacgtaacaccgaccttaacgagttacgacttcgacgaaccacgtacctacgaactagtacgtaagaaccgtaaccggtaccggtttactttaagtacgtcggtgggtcgggtttacttcgttacgttacgttacgttacgacggttcggacggggccgtaacgggtcctggacccttcgtccgttcgaaccg

SEQ ID NO: 440130 - DNA, 636 bp, Homo sapiens
  misc_feature: GZ8MTXP01D6ZIR.45.26.C04.1.454.CMB.2.raw
  modified_base (259)..(259): a, c, t, g, unknown or other
  modified_base (269)..(269): a, c, t, g, unknown or other
  modified_base (286)..(286): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagccgtgggtcctcggtgaggatctcttgcaaggcctcgtggagactccttanacgaaccgtnttctatcgaggttgggngcgacgacggcccctaggacaaggactggagtggagtagggaagatgtctttctattacttaatacaagacgacctacgacacagtactaccttacgaacgggcaacgtactcctaccgtaacgttaccggacggaacgtacgtaccgaacgacgtaacacgtacctacgagtcggactccgtagacccacgtcctacaactactacgtagaacgtaccgtacggttaccgtttagtacgtggtacgggtcggggtaactttcgttaccgttactttacgttacggtacgttacgggttcgggaccgtaacggggtaccctcggtacctccgttccttccgcgtaacccg

SEQ ID NO: 440131 - DNA, 609 bp, Homo sapiens
  misc_feature: GZ8MTXP01BDVDI.45.26.C04.1.454.CMB.2.raw
  modified_base (284)..(284): a, c, t, g, unknown or other
  modified_base (323)..(323): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagccgtgggtcctcggtgaggatctcttgcaaggcctcgtggagtactccttcagaacccgtattctatcagttgggncgacacggcccctggacaaggcttgagtggatgggaagntgcttcctatactttaatacaagagacctacgcacagatccttccgaagggcagtacctctaccacgttacgtaggaccgtagcccgaagacgtaccagtaccctaacagtcggacttcgacgacacgcctacacactcgtagaacgtcgaccggttctttatcgtggtcggcggggtaactttccgttcggtaacctttacgtttcgaaccgtttacggttcgggggttcccgtaacgggggtacccctgggttccctacccgggttcttccccggaactcccgg

SEQ ID NO: 440132 - DNA, 639 bp, Homo sapiens
  misc_feature: GZ8MTXP01A4CUV.45.26.C04.1.454.CMB.2.raw
  modified_base (266)..(266): a, c, t, g, unknown or other
  modified_base (282)..(282): a, c, t, g, unknown or other
  modified_base (287)..(287): a, c, t, g, unknown or other
  modified_base (321)..(321): a, c, t, g, unknown or other
  modified_base (337)..(337): a, c, t, g, unknown or other
  modified_base (354)..(354): a, c, t, g, unknown or other
  modified_base (422)..(422): a, c, t, g, unknown or other
  modified_base (611)..(611): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctggtgaggatctcttgcaggcctgtggagtactccttcagaaccgtnttctatcaggttggtncgacncggcccctggacaaggtctggagtggatgggagntgcttctatacttaanacaagagacctacgcanagactctacgaaggcagtacctctcctacttaccgcgacgtacgtccaagtactacgacgtaccctanacgtggtactccgtacggaccctacgtccctacaactacttccgaagaaacggaccgtacgggttacccttttaagtaccggtgggtacgggtcgggggttaactttccgtttacgttaactttacgtttacggtaccgttacgggttcgggggttacccgtaacgggggtaccccttcggggtacccncccgggttacctcccgttcgtaaccccg

SEQ ID NO: 440133 - DNA, 708 bp, Homo sapiens
  misc_feature: GZ8MTXP01EK5UB.45.26.C04.1.454.CMB.2.raw
  modified_base (226)..(226): a, c, t, g, unknown or other
  modified_base (230)..(230): a, c, t, g, unknown or other
  modified_base (261)..(261): a, c, t, g, unknown or other
  modified_base (341)..(341): a, c, t, g, unknown or other
  modified_base (366)..(366): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtctggtgagntctnttgacaggcctcgtaggacgtacctccttanaacgaacccgtattactatcgaggttggtgcgtacgcggcccccgtggaacgaaggtacttggagtggagtaggggaagntcgtcttaccgttattactttaaanaacgaagacgtaaccctacgacaagacgtacttaccgttaccgaagggctaacgtaccttaccctaccgtacgttaccggaccggaacgtacgtaccaacgtacgtaacacgtaccctagtagttcggacttaccgtacggaacccacggtaccctacaactacgttacgaacggaaaccgaccgttaacccggttacgttttaacgtacgttcgggttacggggacggggtttaactttccgtttacgtttacgttacgttcgtacgttacgggttcggggttcccggtaacgggggtcccctaacggggttcccaccggttccctccgttccgaaccccg

SEQ ID NO: 440134 - DNA, 790 bp, Homo sapiens
  misc_feature: GZ8MTXP01BUD7D.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctggtgaggatctcttgcaaggcctcgtggagactccttcagaaccgtattctatcgagttgggtgcgacacggcccctggaacaaggacttggagtgggagtagggaaaggtatggtacctttcgttaattaccgttttaaaataacaaagtaacgtaaccccttacggacaacgtagaacttcccttacccgaaggggtacccaaggtacccttaccctacccgtaacgtttaacccgggaccggtaaccgaacgttaccccgaaacggaacggttaaccaacgggtacccctttaaacgaagtttacgggaacttcccgtaacggaaacccctacggaccccttaacgaaacctacttaccggtaagaaacccggttaaccgtaccgggttaccccgttttttaaagtaccgttgggttacgggtccggggggttaaactttcccgttttaccgggtttaaccttaacggttttacgggaaccgtttaccggggttcgggggttacccgtaaacggggggtccccctggggttacccaccccgggttcccttcccgttaacccgaaccccgg

SEQ ID NO: 440135 - DNA, 619 bp, Homo sapiens
  misc_feature: GZ8MTXP01A4VYN.45.26.C04.1.454.CMB.2.raw
  modified_base (270)..(270): a, c, t, g, unknown or other
  modified_base (288)..(288): a, c, t, g, unknown or other
  modified_base (330)..(330): a, c, t, g, unknown or other
  modified_base (345)..(345): a, c, t, g, unknown or other
  modified_base (352)..(352): a, c, t, g, unknown or other
  modified_base (377)..(377): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagccgtgggtcctcggtgaggatctcttgcaaggcctcgtggagtacctccttcagaacccgnttctatcgaggttgggtncgacgacggcccctggacaaggacttgagtggagtgggaagntgcttctatcttaanacaaganaacctacgacacagactactaccgngggcacgtactcctacctacgttaccgacggaacacgtaccaacgagtaaccagtaccctatagcggacttaccgcgaaccacgtcctacacgtactcggtagaaacgtcgtaacggttacccttttagtacgttggtcggtcggggtaactttcgttacgttacttacgttcgtaaccgttacgggttcggggaccgaaccgggtacctcggtcctacccggttctaacccgctaacccgg

SEQ ID NO: 440136 - DNA, 737 bp, Homo sapiens
  misc_feature: GZ8MTXP01AENWH.45.26.C04.1.454.CMB.2.raw
  modified_base (264)..(264): a, c, t, g, unknown or other
  modified_base (334)..(334): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctgaggtgaggagcctgggtctcggtgaggatctctgcaaggcctgtggagactccttcacgaaccgtnttctatcgaggttgggtgcgacgacggccccgtaggaccaaggtacgttggaggtggagtgggggaagtntgtacctttcctattactttaaacaacgaagacgtaccccgtacgctaacgtacgtacttacccgttaccgaacgggtacctaacggacccttccgtacccgtaacggttaacccggacgggtaccgtaacgtaccccgaacggtacgtaccgtacgaccctaacagtaccggtaacttccgtaacgaacccgacgtacccgtacgtaactactaccgtaacgaaccgtaccgtaccggtttacccgtttaagttcccgtagggtacgggtcggggtttaactttccggtttaccgttaccgtttaaccgttttcgaaccgtttcgggttccgggggttacccggtaaccggggtaccccttcggtccccgtacccgttcccgtaaccccgttcgtaaccccg

SEQ ID NO: 440137 - DNA, 706 bp, Homo sapiens
  misc_feature: GZ8MTXP01D824D.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctcgtggacgtactccttacagaaccgattctatcgaggttgggtgcgaacgcggccccctggacaaggacttggagtggagtagggaagatcgtctttacgtattacttaaatacaaagacgacctacgacaacgagtactaccttaccgaaggggcaacgtaccctctacccgtacgttacccgggacggtaaccgagtacccgaacggtacgtaacaacggtacccttaacgagttacgggtaacttccgtacgaacccgaacggtcccctacaacctactacgtaaggaaacgaccgtaaccggttacccgttttataaccggtggttcggggtcggggttaacttttccgtttaccggtaactttaacggttttacggtaaccgttaccgggttcgggggccccggtaacgggggtccccttggggtcccctaccggttcccttcccgttccgtaaccccg

SEQ ID NO: 440138 - DNA, 609 bp, Homo sapiens
  misc_feature: GZ8MTXP01EXQ2V.45.26.C04.1.454.CMB.2.raw
  modified_base (230)..(230): a, c, t, g, unknown or other
  modified_base (240)..(240): a, c, t, g, unknown or other
  modified_base (253)..(253): a, c, t, g, unknown or other
  modified_base (262)..(262): a, c, t, g, unknown or other
  modified_base (322)..(322): a, c, t, g, unknown or other
  modified_base (341)..(341): a, c, t, g, unknown or other
  modified_base (372)..(372): a, c, t, g, unknown or other
  modified_base (445)..(445): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagcctgggtcctggtgaggatctnttgcagcctntggagactccttnagaaccgtnttctatcgagttgggtgcgacgacggcccctaggacaaggctggagtggagtgggaagtntgtctttctattacttaanacaagactacctacgacacagctacgtacgnggcagacctctaccagttaccggcgacgacgaccgaacgagtacacgtaccctagtatcggacttcacgaccncgccctactacacttacgagaacgaccgtaccggttaccgtttaatcgttaggtcgggtacggggtaactttcgtttacgtactttacgttcggaccgttacgggttcgggacccgtaagggggtccccttcgggtccctaccggttcctcccgttcgaacccg

SEQ ID NO: 440139 - DNA, 586 bp, Homo sapiens
  misc_feature: GZ8MTXP01BIVCY.45.26.C04.1.454.CMB.2.raw
  modified_base (224)..(224): a, c, t, g, unknown or other
  modified_base (275)..(275): a, c, t, g, unknown or other
  modified_base (281)..(281): a, c, t, g, unknown or other
  modified_base (327)..(327): a, c, t, g, unknown or other
  modified_base (363)..(363): a, c, t, g, unknown or other
  modified_base (427)..(427): a, c, t, g, unknown or other
  modified_base (433)..(433): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgagagcctgggtcctcggtgagntctcttgcaggcctctggagactccttcagaaccgattctatcaggttggngcgacncggcccctggacaaggactgagtggagtagggaagatgcttctatntttaatacaagacacctacgacacagtatcctacgngggcactactctaccacgttaccgacggacacgtccagacgtacacgtacctacagtcgattcncgaccncgcctacacactctaagaacacgtacggttaccgttttatacgtggtcgggcgggttaagtttcgttacgtttacgttcgtttaggacttacgggttcggggccctaagggggtcccttaacgggtcctacccggttctcccgttcgaacccg

SEQ ID NO: 440140 - DNA, 784 bp, Homo sapiens
  misc_feature: GZ8MTXP01BGKH5.45.26.C04.1.454.CMB.2.raw
  modified_base (263)..(263): a, c, t, g, unknown or other
  modified_base (348)..(348): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctctggagactccttcagaaccgnttctatcagttgggtgcgacacggcccctggaacaaggtacttggagtggagtaggggaagatgtcctttcctattactttaaanacgaaagacgtaacctacgacacagtactccttaccgaagggggacaacgggtaccttcccgtaccctaacgtttaaccccgggaccggaaccgtacgttaccccaaacggaggttaaccaacggtaccccttaacgagttacgggaacttaccgtacggaaacccgaacggcccttaacgaacctaacttacgtaacggaaaaccggtacccgttaaccgggttacccgttttttaaacgttaacccggtttgggtaccgggggttaaccggggggttaacgtttttcccgtttttacccgggttaaaccttttaccggttttacggtaacccggtttaaccggggttcgggggaacccccgggttaacggggggtacccccgttcgggttccccgtaccccggttacccggtccccgttaaccgtaaccccggg

SEQ ID NO: 440141 - DNA, 586 bp, Homo sapiens
  misc_feature: GZ8MTXP01D36NO.45.26.C04.1.454.CMB.2.raw
  modified_base (449)..(449): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaacccgattctatcaggttggtgcgacacggcccctggacaaggacttgagtggagtgggaagtatgctttcctagttctttaaatacaagacgacctacgacacagactaccttacgaagggcagtacctctaccacgttaccgacggacgacgtacccagacgtacacgacctacatgatcgtgaaccncgcctacacatactagaacgacgtacggtcctttatacgtgtggcggggtaattcgttcgtaccttagttaggccttagggttcggggaccaacgggggtaccctgggtaccctacggttctaaccgttcgtaaccg

SEQ ID NO: 440142 - DNA, 706 bp, Homo sapiens
  misc_feature: GZ8MTXP01ASB6E.45.26.C04.1.454.CMB.2.raw
  modified_base (352)..(352): a, c, t, g, unknown or other
  modified_base (591)..(591): a, c, t, g, unknown or other
  modified_base (696)..(696): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagccgtgggtcctcggtgaggatctcttgcaaggcctcgtggacgtactccttcagaacccgtattctatcaggttgggtgccgacgacggcccctggaacaaggacttggaggtggagtgggaaggatgtcttctatactttaaanagaagagaccctagacgacaagtactcgttacccgaaggggaccaacggtcccttaccgtacctaaccgttaccgggaccggaacggtacgttacccgaacggtaacggttaacccacggtaaccccttaagaacgttacgggtaactacccggtaacgtacccgagtacccctacgaacgtacttacgaaccgaaacgcccgtaaccgggttaaccgttttactacgtgggtccgggnggggttaactttcgttaccggtttacttccgtttaagtacccggttacggttccgggggttacccgtaacggggtacccgttcggcccgtacccgttccgttccnccgtaacccg

SEQ ID NO: 440143 - DNA, 573 bp, Homo sapiens
  misc_feature: GZ8MTXP01D4WDR.45.26.C04.1.454.CMB.2.raw
  modified_base (287)..(287): a, c, t, g, unknown or other
  modified_base (326)..(326): a, c, t, g, unknown or other
  modified_base (345)..(345): a, c, t, g, unknown or other
  modified_base (376)..(376): a, c, t, g, unknown or other
  modified_base (424)..(424): a, c, t, g, unknown or other
  modified_base (538)..(538): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagccgtgggtcctggtgaggatctcttgcaggcctctggagactccttacagaaccgattctatcgaggttgggtgcgacncggcccctaggacaaggacttggagtggagtagggaagntgcctttactatctttaanacaagacaacctacgcaacagctccttacgngggcagacctctcctagttaccgcgacgacgtccagatacagacctanatcggacttcgcgaccagcctacacatcctagaacgtacgtacggtctttatacgtgtggtcggggaatttccgttacgtactttacgttggaacttcgggttcggggacccgnggggtaccctggtccaccggttctccgttcgcccg

SEQ ID NO: 440144 - DNA, 649 bp, Homo sapiens
  misc_feature: GZ8MTXP01DWDS7.45.26.C04.1.454.CMB.2.raw
  modified_base (226)..(226): a, c, t, g, unknown or other
  modified_base (264)..(264): a, c, t, g, unknown or other
  modified_base (279)..(279): a, c, t, g, unknown or other
  modified_base (316)..(316): a, c, t, g, unknown or other
  modified_base (332)..(332): a, c, t, g, unknown or other
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagccgtgggtcctggtgagntctcttgcaggcctcgtggagactccttacagaaccgnttctatcaggtgggncgacacggcccctggacaggactgagtggatggaagntgctttctatcttaanacaagacgacctcacacagtactcctacgngggcacgaccttctacctagttaccggcggactcgtaccaacgactaaccgacgtaacctacgtaagtcgggattccgtacgaaaccgcgtaccctacaaccgtacgttacgtaacggaaaccgtaccgttaaccggggttaccttttattaccggtgggttcgggtcccgggggttaattttccgttaccgttaaccgtttacgtttcggtaacgttacggggttccggggaccgtaaccgggggtaccctcggtacccgtacccgttcgtcccttcgtaacccgg

SEQ ID NO: 440145 - DNA, 750 bp, Homo sapiens
  misc_feature: GZ8MTXP01B9IA1.45.26.C04.1.454.CMB.2.raw
  modified_base (331)..(331): a, c, t, g, unknown or other
  modified_base (386)..(386): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctcgtggagactccttcagaaccgtattctatcaggttgggtgcgacgacggcccctaggaacaaggtcttggagtggagtaggggaagntgcttctattacttaaatacaagacgtacctacgacaacagtactccgttaccgngggactaacggtaccttcctaccgtaacgttacccggaccgggtaacgtacgttacccgaacggtaacgtaacccgtaacggtacccctaaacgtaacgttacgggaaaccttccctaacggaacccctaaccgtaccccgttaaccaaaccgtaaccttacccggtaaaggaaaccgtaacccgttaaccggggttacccttttaagttaacccggtgggttacgggtaccgggggttaacgtttccgtttaccggttaaacctttacgttttaacgggcgtttaacccgggggttcggggaccccgggtaacggggtaccccttgggtaccccgtcccggttcctccccgttcgtaaccccg

SEQ ID NO: 440146 - DNA, 707 bp, Homo sapiens
  misc_feature: GZ8MTXP01EV5X9.45.26.C04.1.454.CMB.2.raw
  modified_base (247)..(247): a, c, t, g, unknown or other
  modified_base (277)..(277): a, c, t, g, unknown or other
  modified_base (379)..(379): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctgtgganctccttcagaacctattctatcgagttggngcgacacggcccctggacaggctgagtggagtagggaagtgtgtctttacctattactttaatacgaaagacgacctacgacacgagtacttaccttaccgngggacacgtaccttccgtacccgtaacgttacccggacggtaccgacgtacccgaacggacgtaccgacgtacctaacgtagtacgggacttccgtacgaacccgtacgtacccttacgaactacgtaccgtacggaaaccgtaccggtaacccggtttacgttttaacgttaccggttggttaccggggtacgggggttaacttttcccggtttaacgttaccgttttaacgtttcggaaccgttacggggttccgggggaacccgtaaccggggggtccccttaagggttcccccgacccgttccgtccccgttccgtaaccccgg

SEQ ID NO: 440147 - DNA, 779 bp, Homo sapiens
  misc_feature: GZ8MTXP01DHEB2.45.26.C04.1.454.CMB.2.raw
  modified_base (755)..(755): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtctggtgaggatctctgcaaggcctgtggagtacctccttacaagtaaccgtattactatcgtaggttgggtcgccgaacgaccggacccctggaacaaggtacttggagtaggagtaggggaagtgtgtactttactaagtttactttaaagaacaaagacgtaaccctacgacaacgtagtacttaccgttaccggaaggggacctaacggtacccttcccgttaacccgtaacggtttaaccccgggccgggtaaaccgtaccggttaacccggaaacggtaacggtaaccctaacggtaccccgttaaacgtaagttacggggaaacctttccgtaaaccggaaccccgtaaccgtcccctttaccgaaacgtacttaccgaaaggtaaaccgtacccggtaaccggtttacccgttttaaagtacccggtgggttaccggggtcggggttaacttttcccgttagtttaaccgtttacgtttaccggacgtttaccgggcggggacccgtcgggggtaacccttcgggtacccnccggttcctcccgttcgaaccccg

SEQ ID NO: 440148 - DNA, 702 bp, Homo sapiens
  misc_feature: GZ8MTXP01APKMW.45.26.C04.1.454.CMB.2.raw
  modified_base (372)..(372): a, c, t, g, unknown or other
  modified_base (411)..(411): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagccgtgggtcctcggtgaggatctcttgcaagggcctcgtgggacgtaccttccttacgacgtaacccgtattctatcgaggttgggtgcgacgacggccccgtaggaacgaaggtacttggaggtggagtagggaaggtctgtcctttacctattactttaaanacaagtacgaacctacgacaacgagtactacgttaccgngggctaaggtacctccgtaccgtacgttaacccgggaccggtaaccgtacgtacccgaaacggtacgttaacccgacggtaccccttaagacggttacggacttaccgtacgaacccgtaccgtaccctacaacgtcttacgacgaacgaccgtaccggttaccgttttaactcggtggtcgggcggggttaatttccgttacgttaacttcgttacggacgttcgggcggggttacccggaacggggtaccccgtcggttacccacccgttccgtccgttccgtaacccg

SEQ ID NO: 440149 - DNA, 623 bp, Homo sapiens
  misc_feature: GZ8MTXP01DGKKN.45.26.C04.1.454.CMB.2.raw
  modified_base (340)..(340): a, c, t, g, unknown or other
  modified_base (376)..(376): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggctgagtggagtgggaagatgtctttactattactttaaanacaagacgtacctacgacacacgacttccttaccgnggggcaacgacctcctaccacgttaccggcggacgtacgtaccacgagtacacgacctactatcggatcgtagaccacgcctacactatcctagaacgaccgtacggttaccgttttagttaaccgtggtacgggtcgggggtaactttccgtttacggttaacttcgtttagaccgtttacgggttcgggggttacccgtaacgggggtaccctgggtcccacccgttcctcccgttcgtaacccg

SEQ ID NO: 440150 - DNA, 790 bp, Homo sapiens
  misc_feature: GZ8MTXP01EPNOM.45.26.C04.1.454.CMB.2.raw
  modified_base (338)..(338): a, c, t, g, unknown or other
  modified_base (362)..(362): a, c, t, g, unknown or other
  modified_base (384)..(384): a, c, t, g, unknown or other
  modified_base (400)..(400): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctggtgaggtatctcttgacacggcctgtggatacctccttacgaacgtaaccgtattctatcgaggttggtgcgacgtacggcccctaggacaaggacttggagtggagtagggaagtntcgtcctttactattactttaaanacgaagtacgtacctacgacanacgtactacctaccgngggactaacgtacttcctacctacggtacccggacggtaaccgtacgtacccgaaggaacgtaaccgaacgtaccctaaagtacgtcggtaactccgtaacgaaacccgtctaccccttaacaacgtacttacccgtaaaggaaacccgtacccgttaccgggttttaaccgttttaaagttccgggttaccggggttgggtaaccgggggtttaaacctttttccggtttacccgggttttaaacttttaaacccggtttacgggtaaacccggggtttaccgggttaccggggggttaccccggtaaacccggggggtttcccgttaaccgggttcccccgtaacccggtttccccggttaaccccgtttaacccggtaacccccggg

SEQ ID NO: 440151 - DNA, 691 bp, Homo sapiens
  misc_feature: GZ8MTXP01B9GYW.45.26.C04.1.454.CMB.2.raw
  modified_base (372)..(372): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggaagccgtgggtcctcggtgaggtatctcttgcgaaggcctcgtggagtaccttccttacacgtaaccgtattactatcgaggttgggtgcgacgacggtccccgtaggacgaaggtacgttggaggtggaggtagggagtagtcgtcctttactattactttaanacgaagacgacctacgacaagagtacttaccgttaccgcgggacacggtaccttacctacccgtaacgttcccggacgggtacccgacgtaccaacggacgtaaccaacggtacccctaagtagtacggacctacgtacgaccacgtcctacgactactacgacgtaaacgtaccggtaccgtttaccgttactacggtggtcgggtgggttaaccttcgttacgttaccttagttacggtaacgttccgggttcggggacccggtaaccggggttcccgtcggtccccgtaccggttaccctccgttaacgtaacccg

SEQ ID NO: 440152 - DNA, 642 bp, Homo sapiens
  misc_feature: GZ8MTXP01AU5VV.45.26.C04.1.454.CMB.2.raw
  modified_base (226)..(226): a, c, t, g, unknown or other
  modified_base (230)..(230): a, c, t, g, unknown or other
  modified_base (238)..(238): a, c, t, g, unknown or other
  modified_base (242)..(242): a, c, t, g, unknown or other
  modified_base (254)..(254): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcaacagctacaggtgtccagtcccaggtccagctggtgcagtcgtggggctggaggtgaggagccgtggtcctggtgagntctntgcagctntganctctacagactnttcatcgtaggtggtgcgacgacggcccgtaggaacgaaggtcttggaggtaggaggtagggaagtagtcgtccttacgttattacttaaataacgaaagtactactaccgactacgtacgtactccgtaacgaggctacgtacctcctacctacgtaccgacggtaacgtacgtaccgacgtacgacgacgtacctacgagtacgtactctacgacacgcctacacgtactcgtaacgaacgtacgtaccgttacgtttacgttacgtggtcgggtcgggtcgttcgttacttacggggggggggttacttcggtacgtacggttccgggccggaccgggtaacccgtccgtccgtacccgtccgttacctccgttccgtaaccccg

SEQ ID NO: 440153 - DNA, 692 bp, Homo sapiens
  misc_feature: GZ8MTXP01EPO92.45.26.C04.1.454.CMB.2.raw
  modified_base (267)..(267): a, c, t, g, unknown or other
  modified_base (354)..(354): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctcggtgaggatctcttgcaggcctgtgagacctccttacagaaccgtnttctatcgaggtggtgcgacgacggcccctaggacgaggacgttggagtggagtgggaagtagtgtcctttacttattactttaaanaacgaaagacgtaccctacgacaagtactactacccgttaccgaagggtacctaacgtacccttacccgtacccgtaacgttaccccgggaccgggtaaccgtaccgttacccgaacggtaacgtaacgaccgtaccctaacgtagtacggacttccgtacgaccctacgccctactaacgtattaccgaagaaccgaccgttacggttacctttagtaccgtggtcgggtcggttaacgttttcgtttaccgttactttacgttcggacgttacgggttcgggacccgtaaccgggtacccgtcggttcccctacggttccctccgttccgaacccg

SEQ ID NO: 440154 - DNA, 762 bp, Homo sapiens
  misc_feature: GZ8MTXP01B7SZT.45.26.C04.1.454.CMB.2.raw
  modified_base (273)..(273): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggagttcctctttgtggtggcagcagctacaggtgtccagtcccaggtccagctggtgcagtcgtggggctggaggtgaggagccgtgggtcctggtgaggatctcgttgcaaggcctcgtggacgtaccttccttacagaacccgtnttctatcgaggttgggtcgcgtacgacggccccctaggaactaaggacttggagtggagtgggaacgtagtcgtcctttaccgtattaccgtttaaataacgaaggtaacgtaaccgtacgacaacgtaagacttaccgttacccgaacggggaccaacggtacccttacctacccgtaacgttaccccgggaaccgggtaccgtacgtacccgaacggacgttaaccgaacgtaccccgtaagtaacgtcggaacttccgtagaccccgtaccgaccctacgtaacctacgtaccgtaacgaacgtaacccggtacggtttaacccgttttaagttacccggtggtttcgggggtaccggggtttaacgttttccggtttaccgttaaacgtttccgtttacgtaacccggttacgggttccggggacccggttaacggggaccccgttcgggtccccgtacccggttccctccgttccgtaaccccg

SEQ ID NO: 440155 - DNA, 670 bp, Homo sapiens
  misc_feature: GZ8MTXP01CRPEF.45.26.C04.1.454.CMB.2.raw
  modified_base (269)..(269): a, c, t, g, unknown or other
  modified_base (287)..(287): a, c, t, g, unknown or other
  modified_base (334)..(334): a, c, t, g, unknown or other
  modified_base (358)..(358): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggaagccgtgggtcctcggtgaggatctgttgcaaggcctgtggatacctccttcagaaccgtnttctatcgaggttgggtncgacgacggccccgtaggacaaggcttaggagtggagtagggaagtntgtcctttacgtattactttaaanacgaagacgaccctacgacacgagtacttacctaccgaagggaccagtaccctctaccaacgttaccggacggtacgacgtccgaacggtacgtaacacggtacctaacgagttcggactccgtacgaacccgtacgcccttacaagttactacgtagaaacctaccgttaccggttacccttttaagtccgtgggtacggtcggggttaactttcgttccgttaccttagttacgaccggttacggttccggggaccgtaaccggggtacccttcgggtacccgtacccgttcttcccgaacgtaaccccg

SEQ ID NO: 440156 - DNA, 680 bp, Homo sapiens
  misc_feature: GZ8MTXP01DV6VE.45.26.C04.1.454.CMB.2.raw
  modified_base (383)..(383): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagccgtgggtcctcggtgaggatctcttgcaaggcctcgtggagactccttacagaaccgtattctatcaggttgggtcgcgacgacggcccctggaacaaggacttgagtggagtagggaagatgtctttctattactttaatacaagagacctacgacacagactaccttaccgngggcacgtacctcctaccgtacgttaccggacggaaccgtacggtacccaacggactacgacgtaccctacgtagttcggactccgtacgaacccacgtccgttacactacgttaccgaaggaaacgtaccgtaaccgggtttaccgttttaacgttacgtcgggttacggtcgggggttaacttttccgtttacgttaaacctttacgttttacggaccttacggggttcggggacccggtaacgggggtacccttcggggtaccctacccggttccgttcccgttcgtaaccccg

SEQ ID NO: 440157 - DNA, 769 bp, Homo sapiens
  misc_feature: GZ8MTXP01D164Y.45.26.C04.1.454.CMB.2.raw
  modified_base (361)..(361): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacgaggtgtccagtcccaggtccagctggtgcaggtcgtggggctggaggtggaggagccgtgggtccgtgggtgaggtatcttcttgcgaacggtccgtcgtggacgtaccttcccgttacaacggaacccgtattctatcgtaggttggtcgcgacgacggtccccgtaggacgaaggtacgttggagtaggagtagggaacgtnttggtaccctttacgtaatttactttaaacacgtaaagacgtaaccacgtacacgtagtacttcgtaccgaaggacactaccgtacctacgaccgttacggccggtacgtacgaccgtacggaacgttaaccacgtaccgtacgtaacgtgggtaactctaacgaccgactacccttacgaacttacttaccgaaacggtaaccgtaacccggttaaccgttaccgttttttaacaccggtttagggtaccggggtttcgggttaaccttttccgttaaccgggtttaccttttaacgggttcgtaacccggggtttacggacccggggggttaccccggttaacggggtcccgttaacccggggttccctacccgggtttaccctttccccggaaccgtaaccccgg

SEQ ID NO: 440158 - DNA, 629 bp, Homo sapiens
  misc_feature: GZ8MTXP01CV5TR.45.26.C04.1.454.CMB.2.raw
  modified_base (233)..(233): a, c, t, g, unknown or other
  modified_base (251)..(251): a, c, t, g, unknown or other
  modified_base (267)..(267): a, c, t, g, unknown or other
  modified_base (286)..(286): a, c, t, g, unknown or other
  modified_base (322)..(322): a, c, t, g, unknown or other
  modified_base (383)..(383): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggaagccgtgggtctcggtgaggatctnttgcaaggcctcgtgganactcctacagaccgtnttctatcagtggtgcgacncggcccctggacaggacttgagtggagtgggaaagngtgtctttacgtattacttaaataacaagagtaccctacgcacgagtacttacgttaccgnggacaacgtacctctacacgttaccgaccggacgacgtaccgaacgtactaacgacgactaacgataggacttcacgaccgacgtccgtacaactactcgagaacgcgtacgtacctttagtacgtggtcggtaacgggtgttacgttcttacgttacgttttacggaccttaacgggttccgggttacccgtaacgggggtaaccccttcggtacccgtacccgttccgtccgcccgtaacccgg

SEQ ID NO: 440159 - DNA, 710 bp, Homo sapiens
  misc_feature: GZ8MTXP01BS9YE.45.26.C04.1.454.CMB.2.raw
  modified_base (248)..(248): a, c, t, g, unknown or other
  modified_base (265)..(265): a, c, t, g, unknown or other
  modified_base (332)..(332): a, c, t, g, unknown or other
  modified_base (352)..(352): a, c, t, g, unknown or other
  modified_base (388)..(388): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggagccgtgggtcctggtgaggatctcttgcagcctgtggacnctccttacagaaccgtnttctatcgaggttgggtcgcgtacgacggcccctggaacaaggacttggaggtggagtagggaagtntgtcttactattactttaanacgaagacgtacctacgacacgagtactccttacgnggtacacgtacctccgtacctacgttacccggacggacgtacgtaccgaacgtacgtaaccacggtaccctacgagtacgggtactaccgtacgaaccgtaccgacccttaactaacctagtaccgtaacggaaacgtaacccggttacgggttaaccttttaagttaccggtagggtccggggttacggggttaaccgtttacctttaccgggttaaacctttcggtttaaggacccgttaccgggttcgggggaccccggtaacgggggtaccccttcggggttacccacccggttcctccccgttaaccgtaaccccgg

SEQ ID NO: 440160 - DNA, 775 bp, Homo sapiens
  misc_feature: GZ8MTXP01A601L.45.26.C04.1.454.CMB.2.raw
  modified_base (185)..(185): a, c, t, g, unknown or other
  modified_base (492)..(492): a, c, t, g, unknown or other
  modified_base (605)..(605): a, c, t, g, unknown or other
tcagacgcgatcgacacgaccggtgctcgatttagtctagcgactttgggtttggggacataacaaccagattcctcctctaaagaagccccctgggagcacagctcatcaccatggactggacctggaggttcctctttgtggtggcagcagctacaggtgtccagtcccaggtccagctggtncagtcgtggggctggaggtgaggacgccgtgggtcctcgggtgaggtatcttcgttgacgaacggtcctcgtgggacgtacctacccgttcgaacgaacccgttattcctatcgtaggttgggtcgaccggaacgtaccgggtacccccgtagggaaccgtaaacgggtccgtttagggaaggttaggggaaaggttagggggaaaggtacgttcggttaccctttaacccgttaagtttaaccgttttaaaagaacgtaaagaccgtaacccgtaaccgacgtaacacggtactccgttacccggnggggtaccctaaacgccttacccgtaccgtacgttaccccggacgacgtacgtcccgaagtacgaacacgtaccctaagtctacgtacgttacgacgaccgtacgtcccgtanaccgtattacggaccgtaaacgtaccgttaccgtttaccgttttaagtccggttggtaccggggttcgggtaacttttcgttacggtaacttttacgtcggtaacgttccgggttcgggacccggtaacggggtcccttggtaccgtaccgttcccttccgcgtaacccg

SEQ ID NO: 440161 - DNA, 703 bp, Homo sapiens
  misc_feature: GZ8MTXP01CK5L3.45.26.C04.1.454.CMB.2.raw
  modified_base (331)..(331): a, c, t, g, unknown or other
  modified_base (358)..(358): a, c, t, g, unknown or other
  modified_base (394)..(394): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggagccgtgggtcctcggtgaggatctcgtgcaaggcctcgtggagtcttccttcagtaaccgtattctatcgaggttgggtgcgacacggcccctaggactaaggcttgagtggagtagggaagtntcgtactttaccgtattacgtttaaanacgaagacgtacctacgcacgagtctacgttaccgngggactacgaccttctaccgtacgttacccgggacggtacgtacgtacccacgggtaacgtaccacggtaccctaacgagttcgggaacttccgacgaacccaacgtcccgtaactactacgtaccgtaacggaacgaccggttaaccggttccgttttaagtccggttagggtaccgggtcgggttaacttttcccgttgtttaaccgttcgtttacggaccgttaccggggttcgggggttaccccgtaacggggtaccccgtttaacgggcccgttacccggttcctcccgttaacgtaaccccgg

SEQ ID NO: 440162 - DNA, 713 bp, Homo sapiens
  misc_feature: GZ8MTXP01AZ2H5.45.26.C04.1.454.CMB.2.raw
  modified_base (683)..(683): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctgaggtgaggaagccgtgggtcctggtgaggatctcgttgacaaggcctgtaggagtaccttccttacaagtaacccgtattcctatcaggttgggtcgacgaacgacggacccccgtaggaaccgaaggtacttggagtggagtagggaaagtgtcgtcttacgtaattactttaaactaagaaagtacgacccttaacgacgtaaacgaagtacttaccgttaccggaacggggtacccacgtaacctccgtacccgtaacgttacccggaccgggtaaccgacgtaacccgaacggtaacgtaccgacgtacctaacgtagacgtaattccgacggacctaactccgtactaagtcctacgttaacgaaaccgaacgttaccgggttacccttttagtaaccggtggttaccgggcggggtttaacttcgttacggttacttacgttacgtacgttaccggttccgggacgaaccggggttccncggtcctaccgttcctccgttccgaacccg

SEQ ID NO: 440163 - DNA, 608 bp, Homo sapiens
  misc_feature: GZ8MTXP01C439W.45.26.C04.1.454.CMB.2.raw
  modified_base (256)..(256): a, c, t, g, unknown or other
  modified_base (264)..(264): a, c, t, g, unknown or other
  modified_base (284)..(284): a, c, t, g, unknown or other
  modified_base (363)..(363): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttnagaaccgnttctatcagttggtgcgacnggcccctggacaaggacttgagtggatgggaagatgcttcattctttaatacaagtacgactacgcacagatacttccngggcagacctctcacttaccgcggacgagcccacgagtacagacctacataggatactggaacccacggacctccacacttcagtaaacgacgtaacggtacccggtttatttaccgttcgtggtcgggggtaacgtttacgtttcgttacgttaccttttggacctttaaccgttggggaccccggtaagggggaccccgttaagggtttcccgacccggttaccttcccgttcccgtaacccg

SEQ ID NO: 440164 - DNA, 695 bp, Homo sapiens
  misc_feature: GZ8MTXP01DTFYX.45.26.C04.1.454.CMB.2.raw
  modified_base (136)..(136): a, c, t, g, unknown or other
  modified_base (157)..(157): a, c, t, g, unknown or other
  modified_base (232)..(232): a, c, t, g, unknown or other
  modified_base (236)..(236): a, c, t, g, unknown or other
  modified_base (267)..(267): a, c, t, g, unknown or other
  modified_base (285)..(285): a, c, t, g, unknown or other
tcagacgcgatcgacacgaccggtgctcgatttagtctagcgactttgggtttggggacataacaaccagattcctcctctaaagaagccccctgggagcacagctcatcaccatggactggacctggagttcctntttgtggtggcagcagctacnggtgtccagtccccaggtccagcgtggtgcaggtcgtggggctggaggtgaggacgcgtgggtcctggtgaggtntctntgcagcctgtggactctcctacgacgacctnttctatcgaggttgggcncgacgacggtcccctaggacaaggtcttaggaggttaggagtagggagtatcgtacctttacgtattaactttaaacgaacgtaaaggaaccgtaacccgtaaccgactaactaacggtacttacccgttacgcggggtacaaaccgtaccttaccccgtacctaacggttacccgggacgacgtacgtaccgaacgaacgttacgactacccgtagtacgtacggtatccgtacgacctacgacctacacgttatacgacgaaacgtaccgtacggtttactttaacggtgttcggtcggtacgggttctttacgttacgttacgttacgtttcgaacgttcggggttaccgggcccggtaaccggggttcctaacgggttccctaccggttctcccgttcgtaacccg

SEQ ID NO: 440165 - DNA, 552 bp, Homo sapiens
  misc_feature: GZ8MTXP02GLE5S.45.26.C04.1.454.CMB.2.raw
  modified_base (278)..(278): a, c, t, g, unknown or other
  modified_base (360)..(360): a, c, t, g, unknown or other
  modified_base (420)..(420): a, c, t, g, unknown or other
  modified_base (425)..(425): a, c, t, g, unknown or other
tcagacgcgatcgacacgaccggtgctcgatttagtctagcgactttgggtttgggacataacaaccagattcctcctctaaagaagccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtncgacaggcccctggacaaggacttgagtggatggaagatgcttcctatctttaaatacaagagacctacgcacagatcttcngggcagactctccattaccgcgacagtccacgagtacagcctacatggatcgacacgacnctcanctacgtagaacacgacgttacgtttactacgtgtgggtacgggtacgttcgttacgtacttacgttacgtaccgtacggtcggaccggaaccgggtaccgtcgtaccgtcccgtctcctacgacccg

SEQ ID NO: 440166 - DNA, 673 bp, Homo sapiens
  misc_feature: GZ8MTXP02JKSLN.45.26.C04.1.454.CMB.2.raw
  modified_base (339)..(339): a, c, t, g, unknown or other
  modified_base (361)..(361): a, c, t, g, unknown or other
  modified_base (508)..(508): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttccctctttgtggtggcagcagctacaggtgtccagtcccaggtccagctggtgcagtcgtggggctggaggtgaggaagccgtgggtcctcggtgaggatctcttgcgaaggcctgtggagacctccttcgagaaccgtattctatcgtaggttgggtgacgacacggccccgtggaacaaggtacttggagtggagtagggaaggntgtcttacgtattactttaaanacaaagagaaccctacgacaacgaagtactccgttacgacggggtcacgtaacctcctacctaacgttacccggccgggtaaacgacgtacccgaacggaacgtaccgaacgacccttaacgagtacggtactaccgtacgaaaccncgtaccctacactatcgtagaaacgaccgaccggttaccgtttattacgtggtacgggtcgggttaacgtttcctttacggtacttacgtttacggaccgttacgggcggggtacccgaacggggtccccgtagggtaccctaccggtccttccgacgtaccccg

SEQ ID NO: 440167 - DNA, 602 bp, Homo sapiens
  misc_feature: GZ8MTXP02F382A.45.26.C04.1.454.CMB.2.raw
  modified_base (266)..(266): a, c, t, g, unknown or other
  modified_base (339)..(339): a, c, t, g, unknown or other
  modified_base (346)..(346): a, c, t, g, unknown or other
  modified_base (366)..(366): a, c, t, g, unknown or other
  modified_base (430)..(430): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctcgtggagactccttcagaacccgnttctatcagttgggtgcgacacggcccctggacaggacttggagtggatgggaagatgcttctatactttaanacaaganacctacgcacagatcttcgngggcagactctcctattaccgcgacgagtcccacgacgtacacgacctacagtaggacttacgngacccacgcctacacatacgtagaaacgaccgtacgggttaccctttaagttaccgtgggtacggtcgggggttaactttccgtttacggttacctttacgtttacgaccgttacgggtcggggaccgtaacggggtacccttggtaccctccggtccttccgtcgaacccg

SEQ ID NO: 440168 - DNA, 584 bp, Homo sapiens
  misc_feature: GZ8MTXP02FV9D5.45.26.C04.1.454.CMB.2.raw
  modified_base (355)..(355): a, c, t, g, unknown or other
tcagacgcgatcgacacgaccggtgctcgattagtctagcgactttgggttgggacataacaaccagattcctcctctaagaagccctgggagcacagctcatcaccatggactggacctggaggttcctctttgtggtggcagcagctacaggtgtccagtcccaggtccagctggtgcagtcttgggctgaggtgaggaagcctgggtcctcggtgaggatctcttgcaaggcctctggagactccttcagaaccgattctatcagttgggtgcgacaggcccctggacaggacttgagtggatggaagatgcttcctatcttaatacaagagacctacgcacagatcttccngggcagactctccattaccgcggacgagtccacgagtacagcctacatggatctgaccagccctcacatcctgaaacgacaccggtcccgtttttaataccgtaggttcggccggggtagtttctttacggttaacctttacgttttacggaacctttacggtcgggggacccgtaacggggggtacccccttggggtacccgacccggttcttacccgttcgaaccgg

SEQ ID NO: 440169 - DNA, 541 bp, Homo sapiens
  misc_feature: GZ8MTXP02IW3I3.45.26.C04.1.454.CMB.2.raw
  modified_base (361)..(361): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggacttgagtggatgggaagatgcttctatctttaatcaagagacctacgcacagatcttccnggggcagacctctccattaccgcggacgagtccacgagtacagcctacatggatctgaccagccctcacatcctagaacgaccacggtccgtttatactgtgcggggtattcgttcgtacttactttcgacttacgtcggggaccgaacggggaccctggtccaccggtctccgttcacg

SEQ ID NO: 440170 - DNA, 535 bp, Homo sapiens
  misc_feature: GZ8MTXP02IX8MV.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaaggacttgagtggatgggaagatgcttcctatctttaatacaagagacctacgcacagatcttcagggcagactctccattaccgcgacgagtccacgagtacagcctacatgatctgacagcctcacatctagaagacaacggtccgtttataccgtgtagcgggtattcgttcgtacttacttacgactacgttcgggccgaacggggtaccctaggtccaccgtcctcctcacg

SEQ ID NO: 440171 - DNA, 614 bp, Homo sapiens
  misc_feature: GZ8MTXP02GVV38.45.26.C04.1.454.CMB.2.raw
  modified_base (364)..(364): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggcttgagtggatggaagatgcttcctatcttaaatacaagagacctacgcacagactcttaccgngggcagacctctccagttacccgcggacagtacccaacgacgtacagtacctacagttaggacttcgacgacccagccctacactacttcgagaaacgtaccgtacggttaccgtttattaaccgtggtacggtcgggggtaacttttccgttcgttaacctttacgtttacggaaccgtttacggtcgggggtacccgtaacggggtaccccgttcgggtacctacccggtcctcccgttaccgacccg

SEQ ID NO: 440172 - DNA, 558 bp, Homo sapiens
  misc_feature: GZ8MTXP02G327P.45.26.C04.1.454.CMB.2.raw
  modified_base (320)..(320): a, c, t, g, unknown or other
  modified_base (336)..(336): a, c, t, g, unknown or other
  modified_base (343)..(343): a, c, t, g, unknown or other
  modified_base (361)..(361): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggaccaaggcttgagtggatgggaagntgcttctatcttaaanacaaganacctacgcacagatctcngggcagactctccattaccgcgacgagtccagagtacagcctacatggatctacgaccacgcctacacatctagaacgaccgtacggtctttatacgtggtcggcggggttacttcgttacgtacttacgtttacgaccgttacggtcggggaccgtaacggggtaccctcggtaccaccgtcctccgtcgtacccg

SEQ ID NO: 440173 - DNA, 639 bp, Homo sapiens
  misc_feature: GZ8MTXP02JB9C3.45.26.C04.1.454.CMB.2.raw
  modified_base (337)..(337): a, c, t, g, unknown or other
  modified_base (342)..(342): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaaggactgagtggagtggagatgcttctatacttaaatanaaganacctacgcacagactcttccgagggtcagacctctacctacgttaccgcggaacgacgtcccaacgagtacacgacctacagtggactctacgacccagccctacactactactacgaaacgaccgtaaccggtaccttttaacgttaaccgtgggtcggtaccgggggttacgtttacccgtttacgggtaacctttacgttttacggtaccgtttaacggtccgggggtacccggtaaccgggggtaaccccgttcgggtacccgtaccccggttccgttcccgtacgtaccccg

SEQ ID NO: 440174 - DNA, 531 bp, Homo sapiens
  misc_feature: GZ8MTXP02JNKJ7.45.26.C04.1.454.CMB.2.raw
  modified_base (374)..(374): a, c, t, g, unknown or other
  modified_base (388)..(388): a, c, t, g, unknown or other
  modified_base (417)..(417): a, c, t, g, unknown or other
  modified_base (439)..(439): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggaccaaggcttgagtggatgggaagatgcttcctatctttaaatacaagagacctacgcacagatcttcagggcagactcncattaccgcgacgngtaccacgagtacagcctacatcggatcncgaccagcctcacatcagaacncacggtccgtttatactgtgcgggtattctgtactactttgactacgtcggggaccaagggggtaccctgggtccaccggtcctcctcgccg

SEQ ID NO: 440175 - DNA, 518 bp, Homo sapiens
  misc_feature: GZ8MTXP02JD20G.45.26.C04.1.454.CMB.2.raw
  modified_base (279)..(279): a, c, t, g, unknown or other
  modified_base (316)..(316): a, c, t, g, unknown or other
  modified_base (349)..(349): a, c, t, g, unknown or other
  modified_base (358)..(358): a, c, t, g, unknown or other
  modified_base (369)..(369): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggngcgacaggcccctggacaaggctgagtggatggaagntgcttctatctttaatacaagagacctacgcanagatcttcngggcagactcncatccgcgacgagtccagagtacagccacatgatctgaccagcctcacatcgtagaacgacacggtccgtttatctagtcgcgggtattcgttgtactcttagactacgtcgggcaaggggtccctaggtccaccgtctccgtctaccg

SEQ ID NO: 440176 - DNA, 525 bp, Homo sapiens
  misc_feature: GZ8MTXP02FIGXL.45.26.C04.1.454.CMB.2.raw
  modified_base (363)..(363): a, c, t, g, unknown or other
  modified_base (374)..(374): a, c, t, g, unknown or other
  modified_base (433)..(433): a, c, t, g, unknown or other
  modified_base (451)..(451): a, c, t, g, unknown or other
  modified_base (487)..(487): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggacttgagtggatgggaagatgcttcctatctttaaatacaagagacctacgcacagatcttcngggcagactcnccattaccgcgacgagtcccacgagtacagcctacatggatctgaccagcctcacatcngaagacacggtcctttanacgtgtggcgggtagttctgtactattcgactacgngggccaaggggacctcgggtcaccggtctcctacaccg

SEQ ID NO: 440177 - DNA, 609 bp, Homo sapiens
  misc_feature: GZ8MTXP02IXXQL.45.26.C04.1.454.CMB.2.raw
  modified_base (384)..(384): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcaggttgggtgcgacacggcccctggaccaaggactggagtggatgggagatgcttcctattcttaaatacaagagacctacgcacagatctccagggcagactctcataccgngacgagtccacgagtacagacctacatgactcacgacctacgcctacactactctacgaacgacgtaccggttcgttttaatccgttaggtcggtccgggggttagtttcccgttacgttaacctttacgtttacggtaccgttaaccgggtcgggggtacccggtaacgggggttacccccgttgggtacccgtacccggttcccttacccgtccgtaacccgg

SEQ ID NO: 440178 - DNA, 598 bp, Homo sapiens
  misc_feature: GZ8MTXP02JE3QM.45.26.C04.1.454.CMB.2.raw
  modified_base (318)..(318): a, c, t, g, unknown or other
  modified_base (333)..(333): a, c, t, g, unknown or other
  modified_base (360)..(360): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaaggcttgagtggatggaagntgcttctatcttaanacaagacgactacgcacagatcttcgngggcagacctctccattaccgcggacgacgtccacgagtacagcctacagtgatctagacccagccctcacactctagaaacgaccgacggtacctttaagtacgtggtcgacggggttacgtttccgttacgttaccgtttacgtttcgtaaccgttacgggtcggggtacccgtaacgggggtacccccgttcgggtaccccgtacccggttcccttaccccgttccgtaacccgg

SEQ ID NO: 440179 - DNA, 596 bp, Homo sapiens
  misc_feature: GZ8MTXP02HQ7VE.45.26.C04.1.454.CMB.2.raw
  modified_base (417)..(417): a, c, t, g, unknown or other
  modified_base (434)..(434): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaacccgattctatcagttgggtgacgacaggccccctggacaaggacttgagtggatgggaagatcgctttcctatcttaatacaagagacctacgcacagattcctcaggggcagactctaccattaccgacgacgaagccacgagtacagccctaanagtgactcacgaccacncctacacactacgaacgacgacgtaccggttacgtttactacgtcggtacggtacgggttacgtttccgtttacgttacctttacgtttacgtacgttaccggtacggggaccggaaccggggtaccgtacggtcccgtacccgttcctaccgtaccgaccg

SEQ ID NO: 440180 - DNA, 608 bp, Homo sapiens
  misc_feature: GZ8MTXP02H3HJ7.45.26.C04.1.454.CMB.2.raw
  modified_base (276)..(276): a, c, t, g, unknown or other
  modified_base (329)..(329): a, c, t, g, unknown or other
  modified_base (410)..(410): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactcttcagaaccgattcatcagtggtncgacaggcccctggacaagcacttgagtgatggaagatgcttcatctttaaanacaagacgactacgacacagactcgtcgaggacacgactctacactaccgcgacgacgaccgacgagtacacgtacctaanagtagactcgtacgaccgtacgacctacaactactacgtaacgaaacgaccgtaccggttaccgtttaacgttaccgtggtacgggtacggggttacgtttccgttacgttaaccgttacgtttacgtaaccgttacggtcggggtaacccgacggggtaccccgttcggtacccgtacccgttccgtacccgtaccg

SEQ ID NO: 440181 - DNA, 595 bp, Homo sapiens
  misc_feature: GZ8MTXP02GHUVL.45.26.C04.1.454.CMB.2.raw
  modified_base (315)..(315): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaggactgagtgatggagntgcttctatctttaatacaagagacctacgcacagatcttcagggcagactctccattaccgcggacgacgtacccgacgagtacacgtacctacgatcggaatcgtcgacccagccctacacactacgtagaaacgcctacgggtcccgttttaattacgtggtacgggtccgggggtacgtttccgttacgttaactttaccgtttacgaccgttacggtcgggggtcccgtaacgggggtaccccttgggtacccaccgtcccgtccttacgacccg

SEQ ID NO: 440182 - DNA, 533 bp, Homo sapiens
  misc_feature: GZ8MTXP02FUTIJ.45.26.C04.1.454.CMB.2.raw
  modified_base (334)..(334): a, c, t, g, unknown or other
  modified_base (360)..(360): a, c, t, g, unknown or other
  modified_base (428)..(428): a, c, t, g, unknown or other
  modified_base (491)..(491): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaaggactgagtggatgggaagatgcttctatctttaanacaagagacctacgcacagatcttcngggcagactctccattaccgcggacgagtccacgagtacagcctacatggatctgaccagccctcacntactagaacgacacggtccgtttatacgtgtgcgggtattctcgtactacttcgacgttacgnggggaccaaggggtaccctggtaccaccgtctccgtctaccg

SEQ ID NO: 440183 - DNA, 613 bp, Homo sapiens
  misc_feature: GZ8MTXP02IXG2U.45.26.C04.1.454.CMB.2.raw
  modified_base (339)..(339): a, c, t, g, unknown or other
  modified_base (366)..(366): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggaccaaggacttgagtggatgggaagatgcttcctatctttaaanacaagagacctacgcacagatcttccngggcagactctccattaccgcgactagtccacgagtacagcctacatggatctgaccagccctacacactctagaaacgaccgacggtaccgtttaacttaccgtaggtcgggtccgggggtaacgtttccgtttaccggttaacctttacgttttacggtaccgtttaaccggtcgggggtacccgtaacgggggtacccccgttcggggttacccgtacccggttcccttacccgtccgtacccg

SEQ ID NO: 440184 - DNA, 581 bp, Homo sapiens
  misc_feature: GZ8MTXP02GPZYF.45.26.C04.1.454.CMB.2.raw
  modified_base (358)..(358): a, c, t, g, unknown or other
  modified_base (366)..(366): a, c, t, g, unknown or other
  modified_base (565)..(565): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggaccaaggacttgagtggagtaggggaagatgcttcctatctttaatacaagagacctacgcanagatctcngggcagactcaccagtaccgcgacgacgtccgacgagtacagcctacagtcggatcgtacgaccacgtcctacactataccgtagaaacgaccgaccggttaccgtttaattaccgtggttacgggcggggttacgttcgttacgttacgttacgttcgtaaccgtacgtcgggtaccaacggggtacctcggttaccncgtcctccgactaccg

SEQ ID NO: 440185 - DNA, 614 bp, Homo sapiens
  misc_feature: GZ8MTXP02JF7MH.45.26.C04.1.454.CMB.2.raw
  modified_base (278)..(278): a, c, t, g, unknown or other
  modified_base (423)..(423): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctctggagacctcttcagaaccgattctatcagttggtncgacaggcccctggacaaggacttgacgtggatgggaagatgcgttcctatcttaaatcaaagacacctacgcacagatcttcaggggcagacctctccattaccggcgacgtagccaacggatacacgacctacacttggatcngaaccgagaccacacctataccgtagaaacgtacgtaccggtaccttttaagtaccgttaggtcgggacgggggtaactttcgttacggttaacctttaacggttcgtaaccgttaacggttcgggggacccgtaacgggggtaaccccttcgggtacccgtaaccgttcccggttccgttactaacccgg

SEQ ID NO: 440186 - DNA, 564 bp, Homo sapiens
  misc_feature: GZ8MTXP02H6JG8.45.26.C04.1.454.CMB.2.raw
  modified_base (280)..(280): a, c, t, g, unknown or other
  modified_base (318)..(318): a, c, t, g, unknown or other
  modified_base (360)..(360): a, c, t, g, unknown or other
  modified_base (436)..(436): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcgttgaggatctcttgcaaggcctctggagacttccttcagaaccgattctatcagttgggtncgacaggcccctggacaaggacttgagtggatgggagntgcttctatctttaatacaagagacctacgcacagatcttcngggcagctctccattaccgcgacgagtccacgagtacagacctacagtcgatctcgaaccagccctacacgattcngaacgacacggtcctttaattacctaggtcggtcggggtactttcgtttcgttaacttacgttttacgaccgtacgttcggggacccaacgggggtaccctggtccaccggtccttcgttaccgaccg

SEQ ID NO: 440187 - DNA, 570 bp, Homo sapiens
  misc_feature: GZ8MTXP02GC85Y.45.26.C04.1.454.CMB.2.raw
  modified_base (278)..(278): a, c, t, g, unknown or other
  modified_base (336)..(336): a, c, t, g, unknown or other
  modified_base (411)..(411): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctaggtgaggatctcttgcaaggcctctggagactccttcagaaccgattctatcagttgggngcgacacggcccctggacaaggactggagtggatgggaagatgcttctattctttaanacaaagagacctacgacacagtatcttcaggcagactctccattaccgcgacgacgtccacgagtacagacctanatggatctgacccagccctacacactcgtagaacgactacggtacctttaacgttactggtggacggggtactttcgttacgttacttacgtttacgacgttacgtcgggggccgtaacgggggtccccttggtaccctacccgttctcccttcgaccg

SEQ ID NO: 440188 - DNA, 673 bp, Homo sapiens
  misc_feature: GZ8MTXP02G5FXQ.45.26.C04.1.454.CMB.2.raw
tcagacgcgatcgacacgaccggtgctcgatttagtctagcgactttgggtttgggacataacaaccagattcctcctctaaagaagcccctgggagcacagctcatcaccatggactggacctggaggttcctctttgtggtggcagcagctacaggtgtccagtcccaggtccagctggtggagtcgtggggctgaggtgaggaagcctgggtcctcggtgaggatctcttgcaaggcctcgtggagactccttcagaacccgtattctatcagttggtgcgacgacggcccctggacaaggacttgaggtggagtaggggaaggagtgtcctttaccgttattactttaaatacgaagtagaactacccgacacagtactcgttccgagggtccacgtactcctaccagttacccggcgacgacgtcccagacgtacacgtcctacgataggactctacgaaccacgtacctcactatccgtaggaaacgaccgtaaccggttccgtttaagttaccgtggttacgggtacggggttacgtttccgtttacgttaaccgtttaccgtttacggtaaccgttaccgggtcgggggtaccccggaacgggggttcccccgttcggttacccggtaccccggttccctaccccgttaccgacccgtacccccg

SEQ ID NO: 440189 - DNA, 603 bp, Homo sapiens
  misc_feature: GZ8MTXP02H3ML8.45.26.C04.1.454.CMB.2.raw
  modified_base (247)..(247): a, c, t, g, unknown or other
  modified_base (337)..(337): a, c, t, g, unknown or other
  modified_base (343)..(343): a, c, t, g, unknown or other
  modified_base (363)..(363): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctggtgaggatctcttgcaggcctcgtgganactcctcagaaccgattctatcagttgggtgcgacacggcccctaggacaaggacttggagtggagtgggaagatgcttctatcttaaanacaganactacgcacagactcttccngggcagactctaccagttaccgcggacgacgtaccacgacgtacagtacctacatggactcgtacgaccacgaccctacactactacgtacgaaacgtaccgtaccggttaccgtttaagttaaccgttgggtcgtacggggttacgtttcgttacggttacttacgtttacgtaccgtacggttacggggcccgtaacggggtacccgtcggtaccctaccgtccgtacctacgacccg

SEQ ID NO: 440190 - DNA, 605 bp, Homo sapiens
  misc_feature: GZ8MTXP02J0IS2.45.26.C04.1.454.CMB.2.raw
  modified_base (243)..(243): a, c, t, g, unknown or other
  modified_base (336)..(336): a, c, t, g, unknown or other
  modified_base (362)..(362): a, c, t, g, unknown or other
  modified_base (372)..(372): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctntggagactccttcagaaccgattctatcagttggtgcgacaggcccctggacaaggacttggagtggatgggaagatgcttctatctttaaanacaagagacctacgcacagatcttcnggcagactcncattaccgcgacgacgtccacgacgtacacgacctacagttgattcacgaccacgtccctacactacgtcctagaacgaccgtaccgggtacccgttttaagttacgttgggtacgggcgggggttacgtttccggtttaccgtaactttacgtttacggtacttaccggtcgggggtaccggtaacgggggtaccccgtacgggtccgtacccggtcctcccgtacgtaccg

SEQ ID NO: 440191 - DNA, 693 bp, Homo sapiens
  misc_feature: GZ8MTXP02GW1ID.45.26.C04.1.454.CMB.2.raw
  modified_base (228)..(228): a, c, t, g, unknown or other
  modified_base (334)..(334): a, c, t, g, unknown or other
  modified_base (486)..(486): a, c, t, g, unknown or other
  modified_base (506)..(506): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagccgtgggtcctcggtgaggntctcttgcaaggcctgtggagtaccttccttcagaaccgtattctatcgtagtgggtgcgacgacggcccctaggacgaaggtcttggagtggagtagggaaggtntgtcctttaccgtattacctttaaatacaaagtacgaccctacgtaccaactagtacttaccgttaccgacggggactaaacggtaccttaccgtacccgtaacgttacccgggcggtaaacccgcgtacccgacgacgtacgacgacctangttacgactcgtacgacccncgtacctctacacttacgacgaaacgtaccgtaccggtttaccgtttaagttccggttagggtacgggttacgggggtttactttcccggtttaacgttacctttaccggtttacgtaccgttaccgggtgggtacccggtaacgggtacccgtacggtaccgtcccgtcgacccgtcgtaaccccg

SEQ ID NO: 440192 - DNA, 601 bp, Homo sapiens
  misc_feature: GZ8MTXP02GN9LC.45.26.C04.1.454.CMB.2.raw
  modified_base (265)..(265): a, c, t, g, unknown or other
  modified_base (280)..(280): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgtggagtactccttcagaaccgnttctatcagttgggngcgacacggcccctggacaaggacttgagtggagtgggaagtatgcttacgtattacttaaatacgaagtacgacctacgcacagtactccttcgagggtcacgtacctctaccctagttacccggcggtaacgtacgtacccacgtacgtacagtacctacagtcggactcgtacgacctagccctacactatctagaacacgtacggtctttaatacgtggtacggtcgggtacttcgttacgtacttacgttgaccttacggtcgggtaccgtaaccggggtcctcgggtacctaccgtccgttaccgtacgtacccg

SEQ ID NO: 440193 - DNA, 592 bp, Homo sapiens
  misc_feature: GZ8MTXP02JZLLC.45.26.C04.1.454.CMB.2.raw
  modified_base (355)..(355): a, c, t, g, unknown or other
  modified_base (434)..(434): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaccgattctatcagttgggtgcgacaggcccctggacaaggacttgagtggagtgggaagatgcttctatctttaaatacagagactacgcacagancttccagggcatacgtctaccagttacccgcggacgacgtcccacgagtacagctacatggatcagacccagccctacncactacgtacgaacgacgtaccggtaccgtttacgttacgtacggtacgggtacggggttacggttacgttacgttacgttacgttacgtaccgtacggtacggggaccggtaaccgggtacccggtccggtaccgtacccgtccgtccgtaccgccg

SEQ ID NO: 440194 - DNA, 531 bp, Homo sapiens
  misc_feature: GZ8MTXP02GFL4M.45.26.C04.1.454.CMB.2.raw
  modified_base (256)..(256): a, c, t, g, unknown or other
  modified_base (319)..(319): a, c, t, g, unknown or other
  modified_base (337)..(337): a, c, t, g, unknown or other
  modified_base (344)..(344): a, c, t, g, unknown or other
  modified_base (363)..(363): a, c, t, g, unknown or other
  modified_base (384)..(384): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttnagaaccgattctatcagttgggtgcgacaggcccctggacaaggacttgagtggatgggaagntgcttctattctttaaanacaaganacctacgcacagatcttcngggcagactctccattaccgngacagtccacgagtacagcctacatggactctgaccagccttacacatactagaacgacgacggtcgtttaatacgtggtgcgggtattcgttacgtactacttcgactacgtcgggaccaagggtacctcggtcacgtctctcacg

SEQ ID NO: 440195 - DNA, 560 bp, Homo sapiens
  misc_feature: GZ8MTXP02J1Z5L.45.26.C04.1.454.CMB.2.raw
  modified_base (280)..(280): a, c, t, g, unknown or other
  modified_base (319)..(319): a, c, t, g, unknown or other
  modified_base (356)..(356): a, c, t, g, unknown or other
  modified_base (363)..(363): a, c, t, g, unknown or other
  modified_base (388)..(388): a, c, t, g, unknown or other
  modified_base (407)..(407): a, c, t, g, unknown or other
  modified_base (426)..(426): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcgggtgaggatctcttgcaaggcctctggagactccttcagaccgattctatcagttgggtncgacaggcccctggacaaggcttggagtggatgggaagntgcttctatctttaaatacaagagacctacgcacagntcttcgngggcagcctctcactaccgcggacngtccacgagtacagcctanacgtggatctcgaccgacncctacactataccgagaacgaccgtacgggtactttacgtactggtcggcgggtactttcgttcgtacttacgttcgacgtacggtcggggaccaacgggggtaccctggtaccctccggtcctacctcgaccg

SEQ ID NO: 440196 - DNA, 654 bp, Homo sapiens
  misc_feature: GZ8MTXP02FT1A2.45.26.C04.1.454.CMB.2.raw
  modified_base (263)..(263): a, c, t, g, unknown or other
  modified_base (338)..(338): a, c, t, g, unknown or other
  modified_base (345)..(345): a, c, t, g, unknown or other
  modified_base (366)..(366): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctgggctgaggtgaggaagcctgggtcctcggtgaggatctcttgcaaggcctctggagactccttcagaaccgnttctatcagttgggtgcgacacggcccctggacaaggtactgagtggatgggaaggatgcttctattactttaanacaaganacctacgcacagactcttacngggcagactctcctacgttaccgcggacgacgtcccgagacgtaccacgtaccctacgaagtacgggacttacgtacgaaccccacgaccccttaccacgtacttaccgtaaacggaaacgtaaccgtaaccggttaccgtttttaactaacggtggttacggggtccggggttaacgtttccgtttacgttaaccgttacgttttacgacgtttaccggtcgggggtacccgaaccgggggttcccgtacgggttccccaaccggtttccctacccgtcgtaacccg

SEQ ID NO: 440197 - DNA, 534 bp, Homo sapiens
  misc_feature: GZ8MTXP02JTVHJ.45.26.C04.1.454.CMB.2.raw
  modified_base (361)..(361): a, c, t, g, unknown or other
  modified_base (372)..(372): a, c, t, g, unknown or other
  modified_base (528)..(528): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggacaggacttgagtggatggaaggatgcttcctatctttaaatacaagagacctacgcacagatctcngggcagactcncattaccgcggacagtccacgagtacagcctacatggatctgaccagcctacacatctagaacgacgacggtccgtttatacgtgtgcggggtattcttcgtactacttcgacgtacgtcggggaccaacggggtaccctggtccaccgtctaccnctaccg

SEQ ID NO: 440198 - DNA, 636 bp, Homo sapiens
  misc_feature: GZ8MTXP02I8X0J.45.26.C04.1.454.CMB.2.raw
  modified_base (320)..(320): a, c, t, g, unknown or other
  modified_base (337)..(337): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctcgtggagactccttcagaaccgattctatctagttgggtgcgacacggcccctggacaaggcttgagtggatggaagntgcttctattacttaanacaagactacctacgacacagtactcgttacgaggggcacgtacctcctacctacgttaccggcggacgacgtacccaacgacgtacacgacctacagtggatctacgaccacgcctacactatacgtagaaacgaccgtaaccggtaccgttttaacttaccgtggtacgggtacggggttaacgtttccgtttaccgttaccgtttacgtttacgtaaccgttacggttccgggggacccggtaaccgggggtaccccttacgggtacccgtacccggttccctcccgtacgacccg

SEQ ID NO: 440199 - DNA, 578 bp, Homo sapiens
  misc_feature: GZ8MTXP02IUC1A.45.26.C04.1.454.CMB.2.raw
  modified_base (247)..(247): a, c, t, g, unknown or other
  modified_base (318)..(318): a, c, t, g, unknown or other
  modified_base (333)..(333): a, c, t, g, unknown or other
  modified_base (340)..(340): a, c, t, g, unknown or other
  modified_base (352)..(352): a, c, t, g, unknown or other
  modified_base (360)..(360): a, c, t, g, unknown or other
  modified_base (483)..(483): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctctgganactccttcagaaccgattctatcagttgggtgcgacacggcccctggacaaggactgagtggatgggaagntgcttctatcttaanacaaganacctacgcacanatcttcgngggcagactctccacttaccgacgacagtacccacgagtaacagaccgtacagttcggatctagacccagccctacacactctagaaacgccacgggtactttatacgtgtcggacggggttnttccgttacgtaacgtttacgttcgtaccgttaacggtcggggtaccgaacggggtaccctcgggtaccctaccggtcctttccgaactccccgg

SEQ ID NO: 440200 - DNA, 627 bp, Homo sapiens
  misc_feature: GZ8MTXP02G1HYL.45.26.C04.1.454.CMB.2.raw
  modified_base (279)..(279): a, c, t, g, unknown or other
  modified_base (320)..(320): a, c, t, g, unknown or other
  modified_base (339)..(339): a, c, t, g, unknown or other
  modified_base (347)..(347): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcaagaccgattcatcaggttgggncgacacggcccctggacaaggacttggagtggatgggaagntgcttactattactttaanacaaaganacctacgacacagtatccttacgaggggcagacctccacctacttaccgcgaacgacgtaccacgacgtacacgaccctacgatcggaactcgagaccacgcctacacctagtacctagaaacgtaccgtaccggttaccgtttaagttacctagggtacggccggggttaacgtttcgtttaccgttacgtttacctttaacggtacccgtaacggtcggggtaaccgtaaccgggggtcccttacgggtaccctaccggttccctccgtacgaccccg

SEQ ID NO: 440201 - DNA, 565 bp, Homo sapiens
  misc_feature: GZ8MTXP02HQ0Q9.45.26.C04.1.454.CMB.2.raw
  modified_base (341)..(341): a, c, t, g, unknown or other
  modified_base (360)..(360): a, c, t, g, unknown or other
  modified_base (422)..(422): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactcttcagaaccgattctatcagttgggtgcgacaggcccctggacaagcttgagtggatgggaaggatgcttcctatcttaaatacaaganacctacgcacagatctcgnggcagactctcactaccgcgacagtccacgagtacagcctacatggaacttcacgaccgacncctacacatacgagaacgacgtacggtactttatacgtggtcgggtacgggttacttacgttacgttacttacgttacgtacgtaccggtcgggaccggtaaccgggtaccgtacggtcccgtaccgtccgtccctacgaccg

SEQ ID NO: 440202 - DNA, 595 bp, Homo sapiens
  misc_feature: GZ8MTXP02HOXLI.45.26.C04.1.454.CMB.2.raw
  modified_base (280)..(280): a, c, t, g, unknown or other
  modified_base (345)..(345): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtncgacaggcccctggacaaggacttgagtggagtgggaagatgcttcctatctttaatacaagtanacctacgcacagatccttaccaggggcagaccttctacctattacccggcgacgacgtccaacgagtacagcctacagtggatcgtcgaccacgcctacacatcgtagaacgaccacgggtacctttaacttacgtggtacggtcggggttactttcgtttacgttaacctttacgtttacgaccgttaacggtcggggaccgtaacgggggtcccttcggtccgacccggttccgtcccttacgacccg

SEQ ID NO: 440203 - DNA, 632 bp, Homo sapiens
  misc_feature: GZ8MTXP02HAQ4T.45.26.C04.1.454.CMB.2.raw
  modified_base (244)..(244): a, c, t, g, unknown or other
  modified_base (248)..(248): a, c, t, g, unknown or other
  modified_base (264)..(264): a, c, t, g, unknown or other
  modified_base (327)..(327): a, c, t, g, unknown or other
  modified_base (490)..(490): a, c, t, g, unknown or other
  modified_base (616)..(616): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgngganactccttcagaaccgnttctatcgaggttgggtgcgacgacggcccctggaacgaaggtactgagtggagtagggaagntgtcttcgtattacttaatacaagtagacctacgcaacgagtctactcgaggggcagactcctacctacgttaccgacggaaccgtacgtacccgaaggtacgtaacccaacgtacccttacgaagttaccggtaatccgtagaacccgtacgttacccctanaacgttactaccgtaaggaaccgtaccgtaaccggttacgtttaacgtacgtggtacgggcgggtttactcgtttacgctttaacgtcgtaacgtcgttacgggaccgaacgggtcctcggtaccncgtcctccgacgtccg

SEQ ID NO: 440204 - DNA, 547 bp, Homo sapiens
  misc_feature: GZ8MTXP02IDVMQ.45.26.C04.1.454.CMB.2.raw
  modified_base (342)..(342): a, c, t, g, unknown or other
  modified_base (361)..(361): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattcatcagttgggtgcgacaggcccctggaccaaggacttgagtggatgggagatgcttcctatctttaatacaaganactacgcacagatcttccnggggtcagacctctcccattaccgcgacgagtccacgagtacagcctacatggatctgaccagcctacacatctagaaacgacgtacggtccgtttaattacctgtggtacggggtactttcgttcgtacttacgttgtactacgtgggaccaaggggtaccctggtccaccgtctccgtctaccg

SEQ ID NO: 440205 - DNA, 608 bp, Homo sapiens
  misc_feature: GZ8MTXP02IBGUX.45.26.C04.1.454.CMB.2.raw
  modified_base (369)..(369): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacacggcccctggacaaggacttgagtggagtgggaaggatgcttcctattctttaaatacaaagagacctacgcacagactcttcnggggcagactctccattaccgcggacgacgtcccacgagtacagcctacatggactctacgacccagccctacactactctagaaacgactaaccgggtcccttttaagttaccgtgtacgggtccgggggtacgtttccgtttacggttacctttacgtttacggaccttaacggtcgggggtacccgtaacgggggaccccgttagggtcccgtacccgtctcccgtaccgtacccg

SEQ ID NO: 440206 - DNA, 638 bp, Homo sapiens
  misc_feature: GZ8MTXP02G6JH5.45.26.C04.1.454.CMB.2.raw
  modified_base (449)..(449): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgtattctatcagttgggtgcgacaggcccctggaccaaggcttggagtggatgggaagatgccttctattctttaaatacaagagacctacgacacagactcttcgagggcagtactcctactacttacccggcggacacgtcccaacgtaacgtacagaccttacagttaggactctacgaaaccncgtaccctcaacacttccgagaaacgacgtaaccggttccgtttaacgttacgttcgggtacggtccgggggttaattttcccgttacggtttaccgtttaacgtttcgtaacgttaccggtccgggggtaccgaaccgggggttacccgtcggggttaccctaccgggttcccttaccgtcgtacccg

SEQ ID NO: 440207 - DNA, 577 bp, Homo sapiens
  misc_feature: GZ8MTXP02ILAAU.45.26.C04.1.454.CMB.2.raw
  modified_base (336)..(336): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtccccaggtccagctggtgcagtctggggctgaggtgaggaagcctgggtcctcggtgaggatctcttgcaaggcctctggagactccttcagaaccgattctatcagttgggtgcgacaggcccctggacaaggcttgagtggatggaagatgcttcctatctttaaanacaaagagacctacgcacagactcttccaggggtcagacctcctaccctattacccggacggacgagtacccacgaggtacagcctaacagtggatcctgaccagccctacgacattcagaacgacgacggttacctttattacctgtggcgggtacgtttcttacgtactttacgttcgtacgttacgtcgggaccgtaacggggtaccctgggtccaccggttcctacccgtcaacccg

SEQ ID NO: 440208 - DNA, 646 bp, Homo sapiens
  misc_feature: GZ8MTXP02I2O77.45.26.C04.1.454.CMB.2.raw
  modified_base (328)..(328): a, c, t, g, unknown or other
  modified_base (349)..(349): a, c, t, g, unknown or other
  modified_base (356)..(356): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggatctcttgcaaggcctcgtggagacctccttcagaacccgtattctatcagttggtgcgacacggcccctggacaaggacttggggtggagtaggggaaggtntgtctttcctattctttaaanacaaganactacgcacagactctcaggcacgactctccattaccgcgacgacgtccaacgacgtacacgtaccctacgagtaggacttccgacgacccacgtcccctacaactactccgttaagaaaacgtaccgacgggttacccttttaagtttacgtggtacggtacgggggtagttttacccgtacggtttaacttaccgtttacggaaacccgtttacggggtccgggggtacccgaccgggggtaaccccttcgggtaccctacccggtcctacccctccgacgtcccccg

SEQ ID NO: 440209 - DNA, 592 bp, Homo sapiens
  misc_feature: GZ8MTXP02HPDFD.45.26.C04.1.454.CMB.2.raw
  modified_base (343)..(343): a, c, t, g, unknown or other
  modified_base (362)..(362): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctctggagactccttcagaaccgattctatcagttgggtgcgacgaggcccctggacaaggcttgagtggatgggaagatgcttctatcttaaatacaaganacctacgcacagatcttcngggcagacctctccactaccgcggacgtagccgaagacgtacacgtacctacgattggaactcgtacaccaagcctacactatcgtaagacgacgtacggtccgttttaatcgtggtcggcggggttacttccgtttacgttaaccgttacgttttacgaccgttacggtccggggtaccgaacgggggtccccgttcgggtaccacccggttcctcctttaccgacccg

SEQ ID NO: 440210 - DNA, 657 bp, Homo sapiens
  misc_feature: GZ8MTXP02HKRJG.45.26.C04.1.454.CMB.2.raw
  modified_base (348)..(348): a, c, t, g, unknown or other
  modified_base (375)..(375): a, c, t, g, unknown or other
  modified_base (448)..(448): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagccgtgggtcctcggtgaggatctcttgcaaggcctcgtggagactccttcagaacccgattctatctagttgggtgcgacacggcccctggacaaggacttgagtggagtgggaagatgtcttaccgtattactttaaanacaagagacctacgcacagatcttcgngggcagactctacctataccgcgacgacgtcccaagacgtacacgacctaacgatcggaattccgcgaaaccncgccctacactactcgtaagaacgacgtaccggttaccgttttaagtccgtgggtacggaccggggttactttcccgtttacgtttaacccgttacgtttttacggaacccgttaacggggttccgggggtacccggtaaccgggggtaccccttccggggttaccccgtaaccccggtttccctacccggtttaccggtaacccccgg

SEQ ID NO: 440211 - DNA, 586 bp, Homo sapiens
  misc_feature: GZ8MTXP02JR8G0.45.26.C04.1.454.CMB.2.raw
  modified_base (335)..(335): a, c, t, g, unknown or other
  modified_base (342)..(342): a, c, t, g, unknown or other
  modified_base (361)..(361): a, c, t, g, unknown or other
  modified_base (413)..(413): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacaggcccctggaccaaggcttgagtggatggggagatgcttctatctttaanacaaganacctacgcacagatcttcngggcacgactctccacgttaccgcggacgagcccacgagtacagacctacangactacgtcgacccagccctacaactatactagaacaccgtaccggtaccgtttatacgtggtcgcggggttacgtttcgttaccggtacttacgtttcgaccgttacggttacggggaccgtaacgggggtacccttcgggtacctacccggttccctacccgttcacccgg

SEQ ID NO: 440212 - DNA, 676 bp, Homo sapiens
  misc_feature: GZ8MTXP02GPVB8.45.26.C04.1.454.CMB.2.raw
  modified_base (364)..(364): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctgaggtgaggaagccgtgggtcctcggtgaggatctcttgcaaggcctcgtggacgtactccttacagaaccgtattctatcgtaggttgggtgacgacgacggccccgtaggacaaggacttgaggtggagtaggggaagtatcgtacttccgtaattactttaaanaactaaagagtaccctacgactaacagtacttacgttaccgagggtaccaacgtacctcctacctaacgttaccggacgggaacgtacgtacccgaaacgtacgtaaccacgtaccctaacgtagtacgggtacttccgaacgaacccacgtacccttacaactacttaccgtaagaaaccgtacgtaccggttacttttaagtacggtgtacgggcgggttaatttccgttacgttacttagttacgaccgttacggtcggggaccgtaaggggtacccctcgggtacccaccgttctccgacgtaacccg

SEQ ID NO: 440213 - DNA, 675 bp, Homo sapiens
  misc_feature: GZ8MTXP02JQ47Q.45.26.C04.1.454.CMB.2.raw
  modified_base (347)..(347): a, c, t, g, unknown or other
  modified_base (369)..(369): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctctggagactccttcagaaccgattctatcgagttgggtgcgacgacggcccctggacaaggcttgagtggagtgggaagatgcttctattcttaaatacaaganacctacgcacagtatcttacgngggtacagtacctcctacctacgttaccgcggacgacgtacccgacgacgtacacgacctacagtacggactcgtacgaacctcgtccctacgaactacgtacgtaacggaacgtacccgtaccgggtttaccgttttaacgttacgtacggggtcgggtaccgggggtttacgttttcccgtttacggttaacctttaacggttttacggtaaccgtttaccggggtacgggggtacccgtaaaccgggggttccccttacggggttaccctaccccggtttccgtcccgttaccgtaaccccgg

SEQ ID NO: 440214 - DNA, 613 bp, Homo sapiens
  misc_feature: GZ8MTXP02I78P4.45.26.C04.1.454.CMB.2.raw
  modified_base (252)..(252): a, c, t, g, unknown or other
  modified_base (353)..(353): a, c, t, g, unknown or other
  modified_base (360)..(360): a, c, t, g, unknown or other
  modified_base (370)..(370): a, c, t, g, unknown or other
  modified_base (391)..(391): a, c, t, g, unknown or other
  modified_base (426)..(426): a, c, t, g, unknown or other
  modified_base (436)..(436): a, c, t, g, unknown or other
  modified_base (452)..(452): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagccgtgggtcctcggtgaggatctcttgcaacggcctcgtgganactccttcaagaaccgtattcgtatcgtaggttggtgcgacgacggcccctggaacaaggacttggagtggagtagggagatgtcttctattactttaaanacaaganacctacgcanagctctcgagggcagactccnctactccgcgacgactaccagtacgacagacctanagtgactacncgacctacgcctacanactcgtagaaacaccgtacggttacctttaataccgttagtcggggtacggttaacgtttcgttacccgttacttacggtttacgtacggttaccggtccgggtaccggtaaccggggtcccctcgggtttacccgacccggttccttaccgtcgtacccg

SEQ ID NO: 440215 - DNA, 720 bp, Homo sapiens
  misc_feature: GZ8MTXP02GZM7H.45.26.C04.1.454.CMB.2.raw
  modified_base (544)..(544): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggaagcctgggtcctcggtgaggatcttcttgcgaacggcctcgtggacgtaccttccttacgaacgtaaccgtattctatcgtaggttgggtcgcgacgaccggccccgtaggaacgaaggtactaggtaggtaggaaggtagggaaggtatcggttcctttaccttaattactttaaaatacgaaaggtacgacccgtaaccgactaacgtacgtacttacccgttaccggacggggacctaacgtacccttacctacccgtaacgttacccggaccggtaacgaccgtaccgacgtacgtacacgtaccctagagtcgtaactcgacgaacctacnccctaacactatacgtaacgaacgtaccgtaacgtttacgtttaagttacgtggtcggtacgggtttacttccgtttacgtacgtttacgttacgtaccgttacgggccggggtacccgaaccggggttacccgtacggtacccgttacccgtacccgttccgtacgtaacccccg

SEQ ID NO: 440216 - DNA, 598 bp, Homo sapiens
  misc_feature: GZ8MTXP02FXH5H.45.26.C04.1.454.CMB.2.raw
  modified_base (339)..(339): a, c, t, g, unknown or other
  modified_base (346)..(346): a, c, t, g, unknown or other
  modified_base (360)..(360): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctgggctgaggtgaggagcctgggtcctcggtgaggatctcttgcaaggcctctggagactccttcagaaccgattctatcagttgggtgcgacaggcccctggacaggcttgagtggatgggagatgtcttctatactttaatacaaagnactacgnacagtactcttccnggggtcagtactcctaccgacgttaccgcggaacgacgtacccacgacgtacacgtacctacaattcggatacgttcgacccaagtccctacacattactgaaacgacgtaccggtctttaaacgttcgtggtgggcgggttacgttccgtttacgttacttacgtttacgtaccgttacgtcgggggaccgtaacgggggacccttcgggacctacccggtcctaccgttcaacccg

SEQ ID NO: 440217 - DNA, 714 bp, Homo sapiens
  misc_feature: GZ8MTXP02IKFYF.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctcgtggagtactccttcaagaaccgattctatctagttgggtgcgacacggcccctggaacaaggacttgagtggagtagggaaggatcgtcttaccgtattactttaaataacaaagacgtaacctacgacaacgagtattccttaccgaggggacaacgtacctacctacccgtaacttaccccgacgggaccgtacgtaacccgaacgtaacgttaaccgacgtacccttaagacgtacggtaactccgtacgaacccaacgtccctacaactacttccgaagaacgacgtaccggttacccgtttagttaaccgtgggtacggtaccgggggttacgttttaccgtttacggtttaaacctttaacggttttacgtaccccgttaacgggttcgggggaacccggtaaccgggggtaacccctcgggttaccccgtaacccggttccctacccgtttaccgtaacccgg

SEQ ID NO: 440218 - DNA, 694 bp, Homo sapiens
  misc_feature: GZ8MTXP02I2RES.45.26.C04.1.454.CMB.2.raw
  modified_base (243)..(243): a, c, t, g, unknown or other
  modified_base (247)..(247): a, c, t, g, unknown or other
  modified_base (260)..(260): a, c, t, g, unknown or other
  modified_base (275)..(275): a, c, t, g, unknown or other
  modified_base (280)..(280): a, c, t, g, unknown or other
  modified_base (308)..(308): a, c, t, g, unknown or other
  modified_base (327)..(327): a, c, t, g, unknown or other
  modified_base (344)..(344): a, c, t, g, unknown or other
  modified_base (357)..(357): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaggcctngganactctcagaaccnttctatcaggttggncgacncggccctgacagctgagtggagtggagntgtcttctattacttaaanacaagacacctacgcanagtctccttacgngggtcacgtacctcctaccaacgttccggacgtacgactacccgaagacgtacacgtactaacgagtacggatccgtacgaacccgtacgtccctaccgtaactacgttaccgtaaacggaaaccgtacccggttaacgggtttacccgttttaaagttcggttacggggtacggggtacggggtttaacgttttcccgtttaaccggtttacgtttaaaccgtttacggtaaccgttaaccggggttcccgggggtaacccggggtaaccgggggtacccccgtttacggggttaccccgtaaccccggtttccttaccccggtaccgtaccccgg

SEQ ID NO: 440219 - DNA, 755 bp, Homo sapiens
  misc_feature: GZ8MTXP02JQGPY.45.26.C04.1.454.CMB.2.raw
  modified_base (280)..(280): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagctgggtcctggtgaggatctcttgcaaggcctctggagtacctccttacagaacccgattcatcaggttgggngcgacacggcccctggaacaagggacttggagtgggagtaggggaagtagtggtcctttacctaagttactttaaatacgaagagacctacgacactagtcttcttacgagggcacggtaccttccgtacctaggttaccccggacgggtaacgaccgtaccgtaaacgggtaacgtaccgaacgtacccctaaacacgttacggggtacttaccggtaccggaaacccctagtcccctaactaacccgtaattacccgtaaggaaaccgttaaccggtaacgggtttaacccggttttaatttacccggtagggtttaccgggtcggggggtttaaccttttaccgtttacccggtttaaacgtttacggtttttacccggaaacggttcccggggttacgggggaccccggtaacgggggtaccccgtttacgggggacccctacccggttccttacccgtaccgtaaccccg

SEQ ID NO: 440220 - DNA, 600 bp, Homo sapiens
  misc_feature: GZ8MTXP02F0DEF.45.26.C04.1.454.CMB.2.raw
  modified_base (340)..(340): a, c, t, g, unknown or other
  modified_base (384)..(384): a, c, t, g, unknown or other
  modified_base (396)..(396): a, c, t, g, unknown or other
  modified_base (404)..(404): a, c, t, g, unknown or other
  modified_base (407)..(407): a, c, t, g, unknown or other
  modified_base (413)..(413): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattctatcagttgggtgcgacgacgccccctggacaaggacttgagtggagtagggaagatgcttcctatacttaanacaagagacctacgcacagatctcagggcagctcaccataccgngacgatccaganacagccanagngatacncgacacgcctacactactaccgtagaaccgtaccgtacggttaccgtttaacgttacgtaggtacgggtacgggggttacttttaccggttacgttaccgtttactttacggaaccgtttacgggtcggggtacccgtaacgggggtaccccgtggttaccccgccgttcccgtcctaccgtacccg

SEQ ID NO: 440221 - DNA, 652 bp, Homo sapiens
  misc_feature: GZ8MTXP02JRZEB.45.26.C04.1.454.CMB.2.raw
  modified_base (226)..(226): a, c, t, g, unknown or other
  modified_base (469)..(469): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggagcctgggtcctcggtgaggntctcttgcaaggcctcgtggagacctccttcagaaccgattctatcagttgggtgcgacgacggcccctggacaaggacttgaggtggagtagggaggatgtcttctattacttaaatacaagagacctacgcacagtatcgttccgagggctacgccgtcctacctacgttacccgcggaacgtacgtacccgaacgacgtaccacgtcctaacgagtacggtacctacgtacggtaacccncggtaccctacgaacctatacccggtagaaaccggtaaccgtacgggttacccgttttaagttccgttagggtacgggtaccgggggttacgtttccgttaccggttaactttcgttacgtacgtacggtcggggacgtaacggggtcccttcggtacccacccggttcctccgtacctccgg

SEQ ID NO: 440222 - DNA, 666 bp, Homo sapiens
  misc_feature: GZ8MTXP02GRHO6.45.26.C04.1.454.CMB.2.raw
  modified_base (344)..(344): a, c, t, g, unknown or other
  modified_base (351)..(351): a, c, t, g, unknown or other
  modified_base (362)..(362): a, c, t, g, unknown or other
  modified_base (375)..(375): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagccgtgggtcctcggtgaggatctcttgcaaggcctgtggagactccttacagaacccgtattctatcgtagttgggtgcgacgacggcccctggaacaaggactgagtggagtggaagatgcttctattcttaaanacaaganacctacgacanagtactcttacgngggaccagacctcctaccgtaacgtacccggacggaacgacgtacccgacgtaacgtacaacgtaccctacgagtacggtactacgtacgaaccctacgtaccctacgtaacctacgttacgtaacgaaacgtaccgtaaccgggttaccgttttaagttacccgtaggttcggggtacgggtttacgttcgtttacgttaacctttacgttacggtaccgttacggtcgggggaccgtaaccgggggtacccttcggtaccgtacccgttccgttaccgtacgtaccccg

SEQ ID NO: 440223 - DNA, 602 bp, Homo sapiens
  misc_feature: GZ8MTXP02GGLJD.45.26.C04.1.454.CMB.2.raw
  modified_base (324)..(324): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctctggagactccttacagaacccgattctatcagttgggtgcgacacggcccctggacaaggacttgagtggatgggaaggntgcttcctattcttaatacaaagagacctacgacacagactcttacagggcagactctccagttaccgcggacgagtcccagactacacgactacagtggatctacgaaccacgcctaccgacactctaagaaacgacctacggttaccgttttaacttaccgtaggtcgggtacggggttacgtttacgttaccgttacctttaacgtttcgtaaacgttaccgttaggacgtaaccggacggggtaccctcgggtacctaccgttcctacctcccg

SEQ ID NO: 440224 - DNA, 563 bp, Homo sapiens
  misc_feature: GZ8MTXP02GG1K4.45.26.C04.1.454.CMB.2.raw
  modified_base (279)..(279): a, c, t, g, unknown or other
  modified_base (332)..(332): a, c, t, g, unknown or other
  modified_base (339)..(339): a, c, t, g, unknown or other
  modified_base (362)..(362): a, c, t, g, unknown or other
  modified_base (425)..(425): a, c, t, g, unknown or other
  modified_base (428)..(428): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctcggtgaggatctcttgcaaggcctctggagactccttcagaaccgattcatcagttgggtncgacacggcccctggacaaggcttgagtggatggagatgcttctattcttaanacaaganacctacgactacagactcttacnggggtacacgactcgtaccaacgttaccgcgacgacgtacccacgagtacagaccacatgganctnaccagcctacacatctagacgactacgtcgttactactgtgcgggtattcgttacggttacttaccgttagtacgttaacgtggggaccgtaacgggggtacccctggtaccacccggttctcccttacgacccg

SEQ ID NO: 440225 - DNA, 651 bp, Homo sapiens
  misc_feature: GZ8MTXP02H61VI.45.26.C04.1.454.CMB.2.raw
  modified_base (230)..(230): a, c, t, g, unknown or other
  modified_base (245)..(245): a, c, t, g, unknown or other
  modified_base (258)..(258): a, c, t, g, unknown or other
  modified_base (264)..(264): a, c, t, g, unknown or other
  modified_base (280)..(280): a, c, t, g, unknown or other
  modified_base (317)..(317): a, c, t, g, unknown or other
  modified_base (338)..(338): a, c, t, g, unknown or other
  modified_base (346)..(346): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtccccaggtccagctggtgcagtctggggctgaggtgaggagcctgggtcctggtgaggatctnttgcaggctctgganctcctcagaccgnttctanctagttgggtgcgacncggcccctggacaaggcttggagtggagtagggaagntgtcttacttatactttaaanacgaaganacctacgcacagtactcgttcgaggcagtaccgtcctacctacgtacccggacggtacgtacgtacccgaacgaacgtaccacgtaccctacagtacggacttcgacgaacacgtaccctacactacttacgaagaaccgaacgtaccggtttcgttaagttccgtggtacggggtaccggggttactttcgtttaaccgtttaccgttaacgtttacgttacccgtaaccggggttcggggtaccccggtaacggggtccccgttacggtacccgttaccgtcccgtttccgtaccgtaccccg

SEQ ID NO: 440226 - DNA, 639 bp, Homo sapiens
  misc_feature: GZ8MTXP02JSS66.45.26.C04.1.454.CMB.2.raw
  modified_base (136)..(136): a, c, t, g, unknown or other
  modified_base (228)..(228): a, c, t, g, unknown or other
  modified_base (232)..(232): a, c, t, g, unknown or other
  modified_base (241)..(241): a, c, t, g, unknown or other
  modified_base (244)..(244): a, c, t, g, unknown or other
  modified_base (255)..(255): a, c, t, g, unknown or other
  modified_base (262)..(262): a, c, t, g, unknown or other
  modified_base (268)..(268): a, c, t, g, unknown or other
  modified_base (295)..(295): a, c, t, g, unknown or other
  modified_base (328)..(328): a, c, t, g, unknown or other
  modified_base (454)..(454): a, c, t, g, unknown or other
  modified_base (466)..(466): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctntttgtggtggcagcagctacaggtgtccagtcccaggtccagctggtgcagtcgtggggctggaggtgaggagccgtgggtcctggtgaggntctntgcagctgnganctctcagactntctatgngttggncgacgacgccctggacaaggtctaggngtaggagtggagtatgtcttctattactttaanactaagagtaaccctacgacacgacgtactcctaccggaggcacgtacccttctaccgtacgttaccgcggaaccgacgtacccgaacgtagtaccgaacgtaccctactagttacggacttaccnccggtaaacccnccgtcctacatacgttacgaacgtaacgtacccggttacgtttaccgtttacgtacgggtaggttacggggtacggtttacttaccgttacgtactttacgtacggtaccggtcgggtacgggtaccggaaccggttccgtccggtacccgtaccgtccgtcgtaccgtaccg

SEQ ID NO: 440227 - DNA, 792 bp, Homo sapiens
  misc_feature: GZ8MTXP02HJJZS.45.26.C04.1.454.CMB.2.raw
  modified_base (230)..(230): a, c, t, g, unknown or other
  modified_base (578)..(578): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctggaggtgaggaagccgtgggtcctcggtgaggntctcttgacgaaggcctgtggagtacctccttcaacgaaccgtattctatcgtaggttgggtgacgacgaccggccccgtaggaaccgaaggtacgttggaggtggaagtaggggaaggtagtcggtacctttaccgttaatttacgtttaaaagtaacgtaaaacggtaacggtaacccctaaaccgaccaaacgtagtaaccttacgttaacccgggacggggacctaaggtacccttacccgttaacctaacgttaacccggaccgggtaaccggaaccgttacccgtaaaacgaacgttaaccgaaccgacctaaacctaggttacggaactccgtacgaaccnccgtaccctacgtacaatacgtaaacgaaaccgtacgttaccggttaaccgtttaacgttaccggtggttaaacgggggcgggtttaacctttaccgtttaacgtttaaacgttaccgtttacgtaaccggttacccggggtaacggggtacccgtaaaccgggggttccctaacgggttccccgtacccggttacctcccgttaaccaccccg

SEQ ID NO: 440228 - DNA, 650 bp, Homo sapiens
  misc_feature: GZ8MTXP02I5LQW.45.26.C04.1.454.CMB.2.raw
  modified_base (328)..(328): a, c, t, g, unknown or other
  modified_base (377)..(377): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctggaggtgaggaagcctgggtcctcggtgaggatctcttgcaaggcctctggagactccttcagaaccgtattctatctaggttgggtgcgacacggccccctaggaccaaggacttggagtggagtggaagntgtcttctattacttaaatacaagagacctacgcacatactcttaccgngggacaagacctcctacctaacttacccggcggtaaccgtacgtacccgaacgacgtacacgtacccttaacgacgttggtaactcgtacgaacccgaccgaccttacacctactacgtagaaacgccgtaaccggttcttttaataccgttagggtcggaccggggttaactttccgttacgttacctttacgttacgtaaccgttccggtacgggggacccgtaacggggtacccgttcggtaccgtacccgtctacccgtacgtaccccg

SEQ ID NO: 440229 - DNA, 580 bp, Homo sapiens
  misc_feature: GZ8MTXP02HSE0E.45.26.C04.1.454.CMB.2.raw
  modified_base (244)..(244): a, c, t, g, unknown or other
  modified_base (257)..(257): a, c, t, g, unknown or other
  modified_base (280)..(280): a, c, t, g, unknown or other
  modified_base (305)..(305): a, c, t, g, unknown or other
  modified_base (359)..(359): a, c, t, g, unknown or other
  modified_base (438)..(438): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctcttttgtggtggcagcagctacaggtgtccagtcccaggtccagctggtgcagtctggggctgaggtgaggaagcctgggtcctcggtgaggatctcttgcaaggcctntggagactccttnagaaccgattctatcagttgggncgacaggcccctggacaaggcttgngtggatgggagatgcttctatcttaatacagagacctagcacagactcttacgngggcagacctctccacgtaccgccgacgtactccgaacgagtaccagtacctacgatggatctagaccacgtcctcacntctagaacacgtacgtcgtttatacgtgtacggcgggtactttcgttcgttacttacgtttacgtaccgttaccggtaacgggggccgtaaccgggggtacccctgggttacccgaaccggttccctccgtaccgtacccgg

SEQ ID NO: 440230 - DNA, 680 bp, Homo sapiens
  misc_feature: GZ8MTXP02G2UAA.45.26.C04.1.454.CMB.2.raw
  modified_base (184)..(184): a, c, t, g, unknown or other
  modified_base (253)..(253): a, c, t, g, unknown or other
  modified_base (351)..(351): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtncagtctggggctggaggtgaggaagcctgggtcctggtgaggatctcttgcaaggctctggatctcttnagaccgattctatcgagttggtgcgtacgacggcccctaggaccaaggtctgagtggatgggaagatggcctttcgtattaccgtttaatacgaagtnaaccctagacacagacttccttaccgaggggcctaggtacctacctaccgtaacgttacccggaccgggtaccgtacggttacccgaacgacggttaaaccgaccgtaacccttaccgaaggtttacgggacttaaaccgtcggaaaaccccgttcccgtaccgtaccgtaaccgtacgtacgtacgaaccgtaaccgtaccgttaccgttacgttacgttacggtacggtacggtacgttacgttacgttacgttacgttacgtacgtacggtacggtaccggtaaccggtaccgtacgtaccgtaccgtaccgtaccgtaccgtccg

SEQ ID NO: 440231 - DNA, 691 bp, Homo sapiens
  misc_feature: GZ8MTXP02JBNXB.45.26.C04.1.454.CMB.2.raw
  modified_base (242)..(242): a, c, t, g, unknown or other
  modified_base (275)..(275): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctgggctgaggtgaggagctgggtctggtgagatctcttgcaaggcctctgganactccttcagaaccgtattctatctaggttggngcgacgcggccccgtagaaccgaaggtacttggaggtggagtaggggaaggtagttcgtaccgtttaccttaagtttactttaaactaacgtaaaggtacgaaccccgttaacgacctaacgtaaacgtacgttaccttaccggacgggtacgtaacgtaccgttacctacccgtaacgttacccggaccgggtaacccgacgtacccgaaaccgtagtaaacccaccgttacctaaccgagttacggtacttacaccggacccaacgtccctaacgactaacgttcgtaaacggaacgtaccgtaaccgttcgtttaaacgtaccgttggtcgggtacgggttactttcgttacttacttacgttgtaccgtcgtcgggcgtaacgggccttcggtacctcgtctacctcgaccg

SEQ ID NO: 440232 - DNA, 647 bp, Homo sapiens
  misc_feature: GZ8MTXP02I2KTN.45.26.C04.1.454.CMB.2.raw
  modified_base (263)..(263): a, c, t, g, unknown or other
  modified_base (340)..(340): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctggggctgaggtgaggaagcctgggtcctggtgaggatctcttgcaaggcctctggagactccttcagaaccgnttctatcagttgggtgcgacacggcccctaggaacaaggtacttggagtggagtagggagatgcttctatctttaanacaagacgacctacgcaacgagacttccttacgaggggcaagtacctcctacctaacgttacccggacggaacgacgtacccaaggaacgtaaccacgtaccctaacgagtcgggactccgtacgaacccgacggtccctaaccgactaccttcgtaagaaaccgtaccgtaaccggttacgttttaaactcgtaggtcgggtacggggttactttcgttacgttactttacgtttagaccgttaacggtcgggaccgtaacggggtaccccgtggttacccgaccgtttcctccgtaccgtaaccg

SEQ ID NO: 440233 - DNA, 651 bp, Homo sapiens
  misc_feature: GZ8MTXP02GBSOE.45.26.C04.1.454.CMB.2.raw
  modified_base (272)..(272): a, c, t, g, unknown or other
  modified_base (292)..(292): a, c, t, g, unknown or other
  modified_base (363)..(363): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctgggctgaggtgaggagcctgggtcctcggtgaggatctcttgcgaaggcctcgtggacgtacctccttacaaggtaacccgnttactatcgtagttggggtncgacacggcccctggaacgaggacttggagtggagtgggaagagtgcttcgtattacttaatacaaggtanacctacgcacagtactctcgagggcagtctctacctacgttaccggcgaacgtacgtcccgaacgaacgtacaagtaccctacgagttcgggacttaccgcgaaacccgcgtccctacacacttcgtaagaaacgaccgtacggttacttttaacgtaccgtaggtacggggtacggggttacttttaccgttacggttacctttaacggtttcgtaccgttaaccgggtcggggtacccggtaacggggtacccttggtacccaccggtttctcccgtacgtacccg

SEQ ID NO: 440234 - DNA, 729 bp, Homo sapiens
  misc_feature: GZ8MTXP02G291X.45.26.C04.1.454.CMB.2.raw
  modified_base (575)..(575): a, c, t, g, unknown or other
  modified_base (579)..(579): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctgggaggttcctctttgtggtggcagcagctacaggtgtccagtcccaggtccagctggtgcagtcgtggggctggaggtgaggagccgtgggtcctcggtgaggtactcgtcgttgacgtaacggcctcgtgggacgtaccttcccgttacgaaacgtaacccgtatttccaattcgtaaggttcgggtcgaccgaccgaccggccccgtaggaaccgtaaagggtcttaggaggtggaaggtacggggaagtatcggtctttaccgttattaacgtttaaagtaacgaaacgtacgaaccccgtagacctaaacgagtaccttaccgttacgaggggtcctaacgtaccttaccgtaccgtaacgtaacccggcgtaaaaccgctaacccgtaaagacgtaacccgacgtaccttaacagggtactactacggacaccgtacgttaccncaanacgtttaccgaagtaacccgaaggtacccgttaacgtttagtaccgtgggtacggttaccggttctttacgtacgttaacttacgtacgtaccggtacggttacgggaccgtaacggtaccctacgtacccgtactcgtccgtacgaccg

SEQ ID NO: 440235 - DNA, 816 bp, Homo sapiens
  misc_feature: GZ8MTXP02FPOOJ.45.26.C04.1.454.CMB.2.raw
  modified_base (798)..(798): a, c, t, g, unknown or other
tcagacgcgatcgacacgaccggtgctcgatttagtctagcgactttgggtttggggacataacaaccagattcctcctctaaagaagccccctgggagcacagctcatcaccatggactggacctggaggttcctctttgtggtggcagcagctacaggtgtccagtcccaggtccagctggtgcagtcgtggggctggaggtggaggaacgtccgtgggtccgtcgggtaggaggtactctcgttgaccgaaggcccttcgtggacgtaccgttcccttacgaacgtaacccgtatttacctagttacgtaggttcgggtcgacgaccgaccggccccgtggaaccgtaggtacgtggagggtaggaggtagggtaagtgtacgttaccgttaccgttatttaactttaaagaacgtaaacgtaacggtaacccttaacccgacgtaacgagtaccttccggtaccggtagggacctacgtaccttacctaccgtaacggttacccgggacgtaaccgtccgtacccgaaacgtacggtacaaccgtacctacgaacgtacggtacttaccgaccgtaacgtaccctaccgtaccaaccgtactacggtaaacgtaaacccgtacggttacccggtttaccttttaacggttacgtaggggttacggggtaaccgggggtttactttaccgggttttaaccgttacttttaaccggttaccggttacccgggtaaccgggtccgggggtaccggtaaccgggttcccccgttacggtaccccgttaccggtttccncccgttacgaacccccgg

SEQ ID NO: 440236 - DNA, 661 bp, Homo sapiens
  misc_feature: GZ8MTXP02G9VM6.45.26.C04.1.454.CMB.2.raw
  modified_base (230)..(230): a, c, t, g, unknown or other
  modified_base (274)..(274): a, c, t, g, unknown or other
  modified_base (340)..(340): a, c, t, g, unknown or other
  modified_base (398)..(398): a, c, t, g, unknown or other
  modified_base (482)..(482): a, c, t, g, unknown or other
  modified_base (488)..(488): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtcgtggggctgaggtgaggaagcctgggtcctcgggtgaggtntctcttgacaaggcctcgtggagtaccttcctcaagtaaccgtnttctatcgtaggttgggtgacgacgtcggcccctaggacaaggactggtaggtggagtgggaaggntgtcttctattacttaatacaagtacgtacctacgtacacagtacgttaccgtaccgnggggactagtaccgtctacctacgtaccgcggtacgtactccggaacagtacgcgtaccctaagctaggatccgacgacgaccnccctanactacgtataacgaacgtacccgttacgggtactttaaacgttaccggtggttacgggtacggggtttaccttcgtttacgtactttaccgtttacgaccggtaccgttcggggaaccggtccggggttaacctcgggttaaccctaccggtttcctaccgtcggtaaccccg

SEQ ID NO: 440237 - DNA, 744 bp, Homo sapiens
  misc_feature: GZ8MTXP02I33AP.45.26.C04.1.454.CMB.2.raw
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcaggtctggggctggagtgaggagctgggtcctcggtgaggatctcttgcaaggcctcgtggacgacttccttacgaacgaaccgtattactatctaaggttgggtagccgacgacggccccgtaggacaaggtacttggaggttggagtgggaaggatggtacttaccgtagttactttaaatacgaaagtacgtaacccgtacgactacgaagtactccgtttacccgaaggtctaaggaccttaccgtacctaacggttaccgacggtaaaccgtacgtacccgaacgaacggtaacacgtaaccgttaccaaacggtaggtaacttaccgggtaataaacccggacgtaccgtaccaaacgtaccttaacgttacgaaaccggaccgtaacccggggttaccctttaaggtttaccgttagtaccggggtacgggttaacggtttccggtttacgtttaaccgttaaacgtttacggtaaaccgttacgggtaccggtaccgggtaaccgggtaaccgtccggttaccggtaccgtcctaccccgttagtaccccg

SEQ ID NO: 440238 - DNA, 631 bp, Homo sapiens
  misc_feature: GZ8MTXP02H4VF3.45.26.C04.1.454.CMB.2.raw
  modified_base (240)..(240): a, c, t, g, unknown or other
  modified_base (244)..(244): a, c, t, g, unknown or other
  modified_base (254)..(254): a, c, t, g, unknown or other
  modified_base (267)..(267): a, c, t, g, unknown or other
  modified_base (306)..(306): a, c, t, g, unknown or other
  modified_base (322)..(322): a, c, t, g, unknown or other
  modified_base (328)..(328): a, c, t, g, unknown or other
  modified_base (336)..(336): a, c, t, g, unknown or other
  modified_base (348)..(348): a, c, t, g, unknown or other
  modified_base (404)..(404): a, c, t, g, unknown or other
tcagacgcgatcgacacgaccggtgctcgatttagtctagcgactttgggtttgggggacataacaaccagattcctcctctaaagaagcccctgggagcacagctcatcaccatggactggacctggaggttcctctttgtggtggcagcagctacaggtgtccagtcccaggtccagctggtgcagtcgtggggctgaggtgaggagcctgggtcctggtgaggatctctgcaggctngganctctcagacnttcatcagtggtncgacacggccctggacaaggcttggagtgagtagggagntgcttctattacttanacaganacctacgnacatactcttcngggcagtacctcctaccacgttccggcggaacgtacgtacccgagtaacgtaaccncgttacccttaaacgagtggtaacttccgaacgaacccacgtcccctaactactacgttacacggaaccgagtaccgtttaccgttagttacggtcggtggggtaaccgggtttctttaccgtttacgttacctttaacgttacggtaccgtagggggtcccggaaccgggtaaccggggtacccgtacggtacccgttacccgtccgttcccgaaccgtaccccgg

SEQ ID NO: 440239 - DNA, 752 bp, Homo sapiens
  misc_feature: GZ8MTXP02GYOOY.45.26.C04.1.454.CMB.2.raw
tcagacgcgatcgacacgaccggtgctcgatttagtctagcgactttgggtttggggacataacaaccagattcctcctctaaagaagccccctgggagcacagctcatcaccatggactggacctggaggttcctctttgtggtggcagcagctacaggtgtccagtcccaggtccagctggtgcagtcgtggggctggaggtgaggaagccgtgggtcctcggtgaggatctcgttgcaaggcctcgtggagacctctcgagaaccgtattctatctaggttgggtgacgacacggcccctaggaacgaaggtacttggaggtgggagtaggggaaggtagtgtccgttacctaagttaccgtttaaaataacaaaggtacgtaacccctacgacctaagaagtacttacccgttacggacggggtacaacggtaccttccctacccgtaaccgtttacccggaaacgggtaaacggtaccttacccggaaacgtaacggttaccaaacgtaccctaaccgtaagttacggaacttacccgaacggaaccccttcgaccccttacgaacctacgttacgaacggaaaccaccggtacgggttaaccttttaacgttaacgttgggtaggtccggggttacgtttctttaccggtaaacctttcggtttaactacccgtacggtaccgggggtacgaaccggggtccccgttagggaccccgtaaccggttccttccgaccttaaccccgg

SEQ ID NO: 440240 - DNA, 634 bp, Homo sapiens
  misc_feature: GZ8MTXP02GJKUB.45.26.C04.1.454.CMB.2.raw
  modified_base (228)..(228): a, c, t, g, unknown or other
  modified_base (264)..(264): a, c, t, g, unknown or other
  modified_base (331)..(331): a, c, t, g, unknown or other
  modified_base (350)..(350): a, c, t, g, unknown or other
  modified_base (416)..(416): a, c, t, g, unknown or other
  modified_base (629)..(629): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcaggtctgggctggaggtgaggagccgtgggtcctcggtgaggntctctgacgaagcctgtggagctcctacagaacgtnttctatcgtagtggtcgcgacgacggcccctaggaacgaaggtactggacgtaggagtagggaagtntgtcttactattacttaanaacgaagagacctacgacacgatactactacgcggacacgtactcgtccaacgtcgaccggtacgngtacccgaagtactacacgtaccctagatacggtacacgtcgaaccgtactccgatacgtactacggtaagaaccgtaccgacgtttccgttaaagttccggtagttcggggacggttacgttaccgtttacgtactttacggtacgtacccgtacggggtaccgggtaccggaaccggggtctaccgggtaccctaccgttcgtcccgtacncccgg

SEQ ID NO: 440241 - DNA, 551 bp, Homo sapiens
  misc_feature: GZ8MTXP02IS5HW.45.26.C04.1.454.CMB.2.raw
  modified_base (247)..(247): a, c, t, g, unknown or other
  modified_base (255)..(255): a, c, t, g, unknown or other
  modified_base (279)..(279): a, c, t, g, unknown or other
  modified_base (283)..(283): a, c, t, g, unknown or other
  modified_base (310)..(310): a, c, t, g, unknown or other
  modified_base (321)..(321): a, c, t, g, unknown or other
  modified_base (346)..(346): a, c, t, g, unknown or other
  modified_base (358)..(358): a, c, t, g, unknown or other
  modified_base (424)..(424): a, c, t, g, unknown or other
  modified_base (478)..(478): a, c, t, g, unknown or other
tcagacgcgatcgacacgaccggtgctcgatttagtctagcgactttgggtttggggacataacaaccagattcctcctctaaagaagcccctgggagcacagctcatcaccatggactggacctggaggttcctctttgtggtggcagcagctacaggtgtccagtcccaggtccagctggtgcagtctgggctggaggtgaggaagcctgggtcctggtgaggatctcttgcaaggcctctgganactccttnaagaaccgattctatcagttgggncganacggcccctagaccaaggacttgaagnggatggaaggntgacttccatctttaaatacaaagnacctaacgcaanagatcttacaggggcaagactcgtccaacgttaccgcgaacgagtccaacgagtacaagccctaanaactgaatctgacaaggcctcgacagtcagaaagacacggtcgtttaatactgngacgggtgttcttacgtaactacgtttacactacgtcggaccgaacggaccgtcgtacgtacctctccacacg

SEQ ID NO: 440242 - DNA, 520 bp, Homo sapiens
  misc_feature: GZ8MTXP01EF3Z5.10.88.H11.1.454.CMB.2.raw
  modified_base (220)..(220): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggcttaggtgaagagccctggggcctnagtgaagatctcctgcgaggcttctggttacacctttaacacctatggcatctcctgggtgcgacaggcccctggacaaggactgagtggggtgggtggtcagcgcttaccaagttggctacacaaattatgcacagaagttccaggcagagtcaccatgacacagacacatcacgagacacagcctacataggaactgaggggagcctagagatctgacgacacgtccgtatattctgcgcgagagaacgtaaagttgacgttggtaagttcgggggaacagacgttagcgcgtcgggg

SEQ ID NO: 440243 - DNA, 520 bp, Homo sapiens
  misc_feature: GZ8MTXP01CF396.10.88.H11.1.454.CMB.2.raw
  modified_base (460)..(460): a, c, t, g, unknown or other
  modified_base (483)..(483): a, c, t, g, unknown or other
  modified_base (503)..(503): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaaagttccaaggacagagtcaccatgaccacagacacatccacgagacacagacctacataggaactgggaggagcctgagatctgacgacacggccgtatnttctgcgcgagagacgttaaagngacgtggtagtccggggganacgatgaacgtaaccgg

SEQ ID NO: 440244 - DNA, 550 bp, Homo sapiens
  misc_feature: GZ8MTXP01EBBKX.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggggctggaggtgaagagccctgggggcctcagtgaagatctcctgcgaggcttctggttacacctttaacacctatggcatctcctgggtgcgacaggccccctggacaaggacttgaggtgggggtggggtgggtcagcgcttaccgaagttggctacacaaattatgcaacagaaaagttccaaggacagagtcaccatgaccacagacacataccaacgacgacaacacgaccacatacggaactacgggagggacgaccgtgagatctgaacgacgacggtaccgtatattctagcggcgagagaacgttaaaagttgacgtggtagtcgggggacacgatgaacgaaccggg

SEQ ID NO: 440245 - DNA, 541 bp, Homo sapiens
  misc_feature: GZ8MTXP01DNCM4.10.88.H11.1.454.CMB.2.raw
  modified_base (279)..(279): a, c, t, g, unknown or other
  modified_base (352)..(352): a, c, t, g, unknown or other
  modified_base (359)..(359): a, c, t, g, unknown or other
  modified_base (362)..(362): a, c, t, g, unknown or other
  modified_base (394)..(394): a, c, t, g, unknown or other
  modified_base (407)..(407): a, c, t, g, unknown or other
  modified_base (417)..(417): a, c, t, g, unknown or other
  modified_base (468)..(468): a, c, t, g, unknown or other
tcagcatagtagtgcacgaccggtgctcgatttagcgacagcgagaacacacaaaggggacccaaaaccacaccctccttgggagaatccctagatcacagctcctcaccatggactggacctggagcattccttttcttggtggcaacagcaaacaggtgcccactcccaggttcagctggtgcaggtctggggctggaggtgaagagcccgtggggcctgagtgaagatctcctgcgaggtcttcgtggttaacacctttaaacacctatggcatcnccgtgggtgcgacacggcccctggacaaggacttgaggtggggtggttggcagcgcttacgagttgactacanaaattcnganacagaagtcaggcagagtcacatcgacacaanacacacacacganacacacacanagagagagaggacgcgagagatcgacgaacgacgacgtacgtattacttgngcgagaagaagaaacgtaaaggttaggacggttagggtaacggtacggggaacacgagacgaacgcggtcggg

SEQ ID NO: 440246 - DNA, 547 bp, Homo sapiens
  misc_feature: GZ8MTXP01ELD5L.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttaccacctttaacacctatggcatctccgtgggtgcgacaggcccctggacaaggcttgaggtggggtgggggtggtcaggcgcttaccgaagtttggctacactaaattatgacacagaaacgttccaaggacagagtcaaccatcgaccacagacacatccacgacgcaacacgacctacataggaactgggaggagcctagagatcgtgaacgacgacggtaccgtatattctgcgcgagagaacgttaaagttgacggtggtagttccgggggacacgagtcgaacgtaaccggg

SEQ ID NO: 440247 - DNA, 564 bp, Homo sapiens
  misc_feature: GZ8MTXP01CUNYJ.10.88.H11.1.454.CMB.2.raw
  modified_base (405)..(405): a, c, t, g, unknown or other
  modified_base (545)..(545): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacgacggccccctggacaaggacttgaggtgggggtgggggtggtcagcgtcttaccgaagttggactacaactaaaattatgcaacagaaagttccaaggacagagtcacatcgaccacanacacataccacgagacacacgacctacaatacggaactaggggaaggagacctagaagatcgtaggaacgacgaccggtaccgtattagttctgcgcgaagtaagaacgttaaagttgacggtgggtagttccggggganacgataagaacgtaaccgg

SEQ ID NO: 440248 - DNA, 530 bp, Homo sapiens
  misc_feature: GZ8MTXP01BEDS8.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacaggcccctggacaaggcttgagtggggtgggtggtcagcgcttaccaagttggctacacaaattntgcacagaaagttccaaggacagagtcaccatcgaccacagacacactccacgagcacacgcctacatagaactggggaggagcctgagatctgacgacacggccgtatattctgcgcgagagaacgttaaagttgacggtggtacgttccgggggacacgagtcgaacgtaacccggg

SEQ ID NO: 440249 - DNA, 606 bp, Homo sapiens
  misc_feature: GZ8MTXP01AWYG4.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggccccctggacaaaggacttggaggtggggtgggggtgggtcaggcgcttaccgaagttggctacacaaattatgacacagaaagttccaagggacaggagtcaccatcgaccacagacacactccacgagcaacacgaccctacaacgtaggaacctaggggaacggacggacccgtaggaagacgtcgttacggaaccgacgtaccggttaccggttaattagtttaacgtcggttcggacggttagaaggaacggttaaaagttggacggtaagggttacggttccggggggacacgagtcggaacgtaaccggg

SEQ ID NO: 440250 - DNA, 546 bp, Homo sapiens
  misc_feature: GZ8MTXP01CKXOH.10.88.H11.1.454.CMB.2.raw
  modified_base (194)..(194): a, c, t, g, unknown or other
  modified_base (258)..(258): a, c, t, g, unknown or other
  modified_base (400)..(400): a, c, t, g, unknown or other
  modified_base (408)..(408): a, c, t, g, unknown or other
  modified_base (521)..(521): a, c, t, g, unknown or other
  modified_base (526)..(526): a, c, t, g, unknown or other
  modified_base (544)..(544): a, c, t, g, unknown or other
tcagcatagtagtgcacgaccggtgctcgatttagcgacagcgagaacacacaaagggggaggaactgctcagttaggacccagagggaaccatggaaggcccagctcagcttctcttcctcctgctactctggctcccaggtaccaccggagagattgtgttgacgcagtcgccagccaccctgtctttttcnccaggggacagagtcaccctctcctgtagggccagttatggtgttggcgtccttaatttaaacnggtaaccaacagaaacgtggccaggctcccaggctcctcatctacgaagcatcccaccagggccactggctcccagcccaggttcgatggcaggtgggtcctggggacagtacttcaactctcaccatcagcagcctggacnctagaagntattgactagtttatattgtcagcagcggtagcgtaggtcgtcctttcgacgtttcgggacccgggtactaaaggtcggaaatcgaaaacgtattggtagcgtagcaccgttnttctntctcactccttcctcttntc

SEQ ID NO: 440251 - DNA, 538 bp, Homo sapiens
  misc_feature: GZ8MTXP01DM0PS.10.88.H11.1.454.CMB.2.raw
  modified_base (352)..(352): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggggtggggtggtcagcgcttaccgaagttgctacacaaattntgcacagaaagttccaaggacagagtcaaccatcgaaccacagacacataccacgacgcaacacgacctacataggaactggggaggagcctagagatcgtagacgacgacggaccgtatattctgcgcgagagaacgttaaagttgacggtggtacgttcgggggacacgatgaacgtaaccggg

SEQ ID NO: 440252 - DNA, 579 bp, Homo sapiens
  misc_feature: GZ8MTXP01DXMF0.10.88.H11.1.454.CMB.2.raw
  modified_base (220)..(220): a, c, t, g, unknown or other
  modified_base (367)..(367): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctnagtgaagatctcctgcgaggtcttctggttacacctttaacacctatggcatcctccgtgggtgcgacgacggcccctggacaaaggacttgaggtggggtgggggtggtcagcgcttaaccaaggttggactacactaaaacttangcaacagaaaacgttccaagggacaggagtcaccatcgaaccacagaacacataccacgaagacaacacgacctaaccatacgggaaactggggaaggaggcctagaagatcgtagaacgaccgacggtaccgtatattctgcgcgagaagtaacgttaaaagttcgacggtaaggtaggttccgggggacacgagtcgaacgtaacccggg

SEQ ID NO: 440253 - DNA, 547 bp, Homo sapiens
  misc_feature: GZ8MTXP01CVOSY.10.88.H11.1.454.CMB.2.raw
  modified_base (491)..(491): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggcttctggttacacctttaacacctatggcatctcctgggtgcgacacggccccctggacaaggactttggaggtgggggtgggggtgggtcaggcgtcttaccgaaggttggactacgactaaattatgcaacaggtaaaacgttccaagggacagagtcaccatcgaccacagacacactccacgagacacacgacctacaataggaactgggaggagcctagagatctgacgacgaccggccgtatnttctgcgcgagagacgaaagttgacgtggtacgtcgggggacacgagtgcgaacgg

SEQ ID NO: 440254 - DNA, 626 bp, Homo sapiens
  misc_feature: GZ8MTXP01AWB65.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggcccctgggacaaggcttggaggtggggtgggggtggtcaggcgtctttaccaaggtttcggacttaacgaactaaattatgcaacagaaagttcccaagggacagacgtcaccatcgaccacagacacactaccaacgacgacaacacgacctacagtaggaacgtggggaaggagaccgtagacgagtcgtacggaacggaccgaccgggtacccgttaagttacgtttcgtacggcggacggaaggtaacggtaaacggttaaaaggttggaacgggttaagggttacggttaacccggggggaactacgttacgtcggaaccgtaacccgggg

SEQ ID NO: 440255 - DNA, 586 bp, Homo sapiens
  misc_feature: GZ8MTXP01CUZTX.10.88.H11.1.454.CMB.2.raw
  modified_base (434)..(434): a, c, t, g, unknown or other
  modified_base (460)..(460): a, c, t, g, unknown or other
  modified_base (482)..(482): a, c, t, g, unknown or other
  modified_base (506)..(506): a, c, t, g, unknown or other
  modified_base (511)..(511): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggagggtgaagagcccgtgggggcctcgagtgaagatctcctgcgaggtcttctggttacacctttaacacctatggctatctccgtgggtgccgacgacggccccctggaaccgaaaggactttggaggtgggggtgggggtgggtcaggcgtacttaaccgaagttggacttaacataaaacttatgacaacaggtaaaagttccaagggacagagtcaaccatcgaacacaanacacacacgacgacgacacacgacanagagaacgagggagagcagagntacgacgacgacgtacgtactatnttcgngacgagaagaagtaaacggttaagttcggttacggtaaggtacgggtaacgggacacgagtaacgaacgaaccgg

SEQ ID NO: 440256 - DNA, 628 bp, Homo sapiens
  misc_feature: GZ8MTXP01DZEKW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggtcttctggttacacctttaacacctatggcatctccgtgggtcgcgacacggccccctaggaacaaggtacttggaggtgggggtgggggtgggtcaggccgtcttaaccgaagtttcggactaacaactaaaattatgacaacgaaggtaaacgttccaagggacaaggacgtaccaccatacgaacccacagacaacactaccaacgacgacaacacgacctacagtaggaactaggggaaggacgtccgtagacgtacgtcgtacgaaccgacgtaccggtaccgtattcgttcgtgcgacggaagtaaacgtaacggttaaaagttggttaacggtaagggtacggttaaccgggggaacacgacgtcgaaccgtaaccgggg

SEQ ID NO: 440257 - DNA, 575 bp, Homo sapiens
  misc_feature: GZ8MTXP01DRD5R.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacactttaacactatggcatctccgtggtgcgacacggcccctggacaaaggcttgaggtggggtgggggtggtcaggcgtcttaaccgaaagtttggctaacaactaaaactttatgacaacaagaaaacgttcccaagggacagagtacaaccatgaacccacaagacacataccacgaacgcaacacgacctacatagaactaggggaggagccgtagagaatcgtagaacgacgaaccggtaccgtaatattctcgcgcgagaagaacggttaaaagttgacggtaaggtagttccgggggacacgatcgaacgtaaccggg

SEQ ID NO: 440258 - DNA, 539 bp, Homo sapiens
  misc_feature: GZ8MTXP01AZT02.10.88.H11.1.454.CMB.2.raw
  modified_base (363)..(363): a, c, t, g, unknown or other
  modified_base (407)..(407): a, c, t, g, unknown or other
  modified_base (456)..(456): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggccccctggacaaagggcttggagtggggtggggtgggtcaggcgactttaccaagtttggctacacaaaatttangcaacagaaaagttccaagggacagagtcaccatgaccacaganacatccacgagcacagcctacataggaactagggaggagcctgagatcngacgacacggcccgtataatttctgcgcgagagaacgttaaaagttgacgtggtagttccggggggacacatgaacaacccgg

SEQ ID NO: 440259 - DNA, 597 bp, Homo sapiens
  misc_feature: GZ8MTXP01BXEYB.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatcctccgtgggtcgcgacacggccccctgggaccaaagggacttggaggtgggggtgggggtggtcaggtccgacgtttaaccgaaggtttggactaacaactaaaacttatggcaacaggtaaaacgttcccaagggtacaaggacgtccaaccatcggaccacagacacataccacgagcaacacgacctacagtagaacgtgggaggagccgtagacgatcgtagacggacacggaccgtatattctgcgtcgagaagtaacgttaaaggttgttacggtaaggtacggtaaccgggggacacgactaacgaacgtaaccggg

SEQ ID NO: 440260 - DNA, 568 bp, Homo sapiens
  misc_feature: GZ8MTXP01DHA79.10.88.H11.1.454.CMB.2.raw
  modified_base (353)..(353): a, c, t, g, unknown or other
  modified_base (361)..(361): a, c, t, g, unknown or other
  modified_base (365)..(365): a, c, t, g, unknown or other
  modified_base (395)..(395): a, c, t, g, unknown or other
  modified_base (544)..(544): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggggcctcgagtgaagatctcctgcgaggtcttctggttacacctttaacacctatggcatctccgtgggtgcgacgacggcccctggacaaggacttgaggtggggtggggtggtcagcgacttaccaagttggctanacaaattngcanagaaattcaaggacagagtcacatgaccanagacacactccacgagacacacgcctacagtagaactggggaggacgcctagagaatcgagaaccgactaccgggccttaatacgtttctgacgacggaagaacggtaaacgttaaaagttggacggttggttacgggttccggggganaccgagtcgaaccgtaacccgggg

SEQ ID NO: 440261 - DNA, 720 bp, Homo sapiens
  misc_feature: GZ8MTXP01ANZV2.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatcctcctgcgaggtcttcgtggttacctacctttaacacctatggctatctcgtgggtgcgacgacggccccgtaggacaaggcttggaggtgggggtgggggtggtcaggcgtcttaccgaaggttggactacgaactaaaattagtagacaaccgaaggtaaaacgtttacccgaaggggtaacaaggacgtaccacctagtacgaacccacaagacaacgactaccacgacgacactacgaccctacaacgtacggaaaccgtggggaaacggggtacgcccgttaaggaacgtacgtacgtacggaaaccgaaccggtaacccgggtacccgttaatttaacgttttcgtacggaccgggacggaaacgggtaaacggtaaaccgggttaaaagggttcgggttaaccgggtttaaggggttaccggggtttaaccccggggggaactaacggaacggtttaacgggaacccggttaacccgggggg

SEQ ID NO: 440262 - DNA, 683 bp, Homo sapiens
  misc_feature: GZ8MTXP01CYSTD.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttacacctttaacacctatggcatctccgtgggtgcgacgacggcccctggacaaggacttggaggtgggggtgggggtggtcagcgtcttaccgaagttggactacactaaattatagcacagaaagttccaaggacagagtcaaccatacgaccacagacacactaccaacgagacaacgacgacctaacgagtacggaacgtagggggaacggaacgaccgtaggaagtactacgtacggaaaccggaaccgtaccggggtacccgttaatttaacgttttcggtacggaccgggtaaccggaaagggtaaaccggtaaaacgggtttaaaaacgggttgggttaaaccggggtttaacggggttaaccgggggtttaacccggggggaacaaccggttaagggttaaccggaaccgggttaaccggggg

SEQ ID NO: 440263 - DNA, 601 bp, Homo sapiens
  misc_feature: GZ8MTXP01DO8PI.10.88.H11.1.454.CMB.2.raw
  modified_base (357)..(357): a, c, t, g, unknown or other
  modified_base (362)..(362): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggccccctggacaaggacttggaggtgggggtggggtgggtcagcgcttaccgagttgctacacaaattntgcanagaaagttccaaggacagagtcaccatgaccacagacacactccaacgacgacacaacgacctaacaataggaaacgtaggggaaggacgaccgtaggaagacgtacgtggaaaccgacgtaaccgggtacccgttaattaactttcgttacggcggacggaaggtaacggtaacggttaaaaggttcggacggttgggtaacggttccggggggacacgagtcgaaccgtaacccggg

SEQ ID NO: 440264 - DNA, 701 bp, Homo sapiens
  misc_feature: GZ8MTXP01CZKAR.10.88.H11.1.454.CMB.2.raw
  modified_base (407)..(407): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctgaggtgaagagcccgtggggcctgagtgaagatctcctgcgaggtcttcgtggttacctacctttaacacctagtggctatctccgtgggtcgacgacgacggcccctgggaaccgaaagggtacgttggagggttgggggtagggggtgggtcgaggtccgtaccttaaccgtaaggtttcggacttaacgaactaaaactttagngacaacgaaggtaaacgttcccgaagggaacaagggacgtaccaccaagtacgaaacccaacaagaaccaacacgtaccaacgacgacacacgacctaacgagtacggaactaggggaacggacgaccgtaggacgtacgtccgtaggaaccgaccgtaccggtacccgttaattacgtttcgcggaccggacggaaggaaacggtaaacggttaaaaggttcggttacggttaaggggttaacgggttaacccggggggaacaacggttacggtcggaaccggtaacccgggg

SEQ ID NO: 440265 - DNA, 628 bp, Homo sapiens
  misc_feature: GZ8MTXP01ECIYW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacacggccccctggacaaggacttggaggtggggtgggggtggtcagcgcttaccgaagtttggactacaacaaaatttatgacaacaggaaaagttcccaaggacagaacgtcaaccatcgaacccacacgacacactaccacgacgacaacacgacctaacaagtagaacgtaggggaaggagaccgtgaagatcgtaggaacgacgacgggtacccgttaattacgtttcttggacggtacggaacggaaggtaaacgggttaaaaacggttggttaacgggttaagggttaacggttcccgggggggaactaccggagttaacggaaccgtaacccgggg

SEQ ID NO: 440266 - DNA, 548 bp, Homo sapiens
  misc_feature: GZ8MTXP01DRL1C.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctccgtgggtgcgacgacggccccctggaccaaaggacttggaggtgggggtgggggtgggtcaggcgcttaccgaagttggactacactaaattngcacagaaagttccaaggacagagtcaccatcgaccacagacacataccacgagacacacgacctacagtaggaacgtagggacggagccgtagagatcgtagacgacgacggtaccgtatattctgcgcgagagaacgttaaagttgacgtggtagtcggggacacgatcgcgtaacgg

SEQ ID NO: 440267 - DNA, 646 bp, Homo sapiens
  misc_feature: GZ8MTXP01BQBFP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacacctttaacacctatggcatctccgtgggtgcgacgacggcccctggacaaggtcttggaggtggggtgggggtggtcaggtcgtacttaccgaggtttggactacgaactaaatttagtgacaacgtaggtaaaacgttcccgaagggtaaccaggtacgtaccaacctatacgaacccacacgaacaacactaccaacgacacgacacgacctaacagtagaacgtggggaaggacgccgtaggagagtccgtagaccgacgtaccggtaccgttattactttaacgtcgcggacgaaggaaacgtaacggttaaaaggttcggttaacgggtaacgggttaacgggttcccggggggaactacggttacgtaacgaaccgtaacccgggg

SEQ ID NO: 440268 - DNA, 644 bp, Homo sapiens
  misc_feature: GZ8MTXP01D6IGG.10.88.H11.1.454.CMB.2.raw
  modified_base (377)..(377): a, c, t, g, unknown or other
tcagcatagtagtgcacgaccggtgctcgatttagcgacagcgagaacacacaaaggggacccaaaaaccacacccctccttgggagaatcccctagatcacagctcatcaccatggactggacctggagcatccttttcttggtggcagcagcaacaggtgcccactcccaggttcagctggtgcagtctggggctgaggtgaagacgcccgtggggcctcagtgaagatctcctgcgaggtcttctggttacacctttaacacctatggcatctccgtgggtgcgacgacggcccctaggaaccaaggtcttggaggtgggggtgggggtgggtcagcgtcttaccgaaggttggactaacgaacctaaatttanggaccaacgaaagtaacgttcccgaagggacaggacgtaccaaccatacgacccacacgacacactccaacgacgacaacacgaccctaacagtacggaacgtggaggtacgccgtagagactacgtacggaccgaccgaccggtaccgttattaacgtttcgcggtaccggacggaaacggtaacggttaaacggttaaaggttacggtaacgggttagggttaacgggttacccgggggacacgtaacgttaacggtaacccggg

SEQ ID NO: 440269 - DNA, 621 bp, Homo sapiens
  misc_feature: GZ8MTXP01DZ9IC.10.88.H11.1.454.CMB.2.raw
  modified_base (387)..(387): a, c, t, g, unknown or other
  modified_base (446)..(446): a, c, t, g, unknown or other
  modified_base (521)..(521): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtgggggcctcagtgaagatctcctgcgaggtcttcgtggttaccaacctttaacacctatggcatcctccgtgggtgcgacgacggccccctaggaacgaaaggcttggagggtgggggtgggggtggtcaggcgtacttaaccgaaaggtttggactaacaactaaaatttngacaacaagtaaaacgttcccgaagggacaagggactacaaccagtcgaaacccaacanaacaacactaccaacgaagcaacacgacctaacgaagtacggaaactagggggaacggagaccgtagagattcgngaaacgacgacggacctattacttctgcgacgagaacgtaacgaaaaggttgacggttaaggtacggttaaccgggggacacgagtcgaacgtaaccggg

SEQ ID NO: 440270 - DNA, 567 bp, Homo sapiens
  misc_feature: GZ8MTXP01BW95T.10.88.H11.1.454.CMB.2.raw
  modified_base (370)..(370): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacacctttaacacctatggcatctccgtgggtgcgacgacggccccctggaccaaaggacttggaggtgggggtgggggtggtcaggcgcttaccgaagttggactacgactaaacttangacacagaaagttccaaggacagacgtcacatgaccacacgacacactaccacgacgacacacgaccacagtaggaactgggaaggagacctagaagatcagaacgacgacggaccgtatacttctgcgacggagaagaagttaaaagttggacgtaagggtacggttccgggggacacgagtcggaacgaaccggg

SEQ ID NO: 440271 - DNA, 566 bp, Homo sapiens
  misc_feature: GZ8MTXP01EKKWP.10.88.H11.1.454.CMB.2.raw
  modified_base (403)..(403): a, c, t, g, unknown or other
  modified_base (410)..(410): a, c, t, g, unknown or other
  modified_base (412)..(412): a, c, t, g, unknown or other
  modified_base (416)..(416): a, c, t, g, unknown or other
  modified_base (446)..(446): a, c, t, g, unknown or other
  modified_base (461)..(461): a, c, t, g, unknown or other
  modified_base (464)..(464): a, c, t, g, unknown or other
  modified_base (486)..(486): a, c, t, g, unknown or other
  modified_base (546)..(546): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttactacctttaacacctatggcatctccgtgggtgcgacacggcccctggacaaaggacttggaggttggggtgggggtggtcaggccgttacgtaacgtagttcgactaacaataatgtgacacgaagtaaactacgaagacagacacactanacacgananacanacaccagacacagacactacagtaagacgngggagactcgagatntcncggaacgacgaccggtatattnttcgacgcggagaacgaaggtaaacgttaagcggttaggtaaggtacgggtaaccggganagagtaacgaaccgtcgggg

SEQ ID NO: 440272 - DNA, 561 bp, Homo sapiens
  misc_feature: GZ8MTXP01DSA1T.10.88.H11.1.454.CMB.2.raw
  modified_base (358)..(358): a, c, t, g, unknown or other
  modified_base (368)..(368): a, c, t, g, unknown or other
  modified_base (543)..(543): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggggctggaggtgaagagcccgtgggggcctcagtgaagatctcctgcgaggtcttctggttactacctttaacacctatggcatctcctgggtgcgacaggccccctggacaaggacttgaggtgggggtggggtgggtcaggcgacttaccgaagttggactanactaaaattntgacacagaaacgttccaagggacagagtcaccatgaccacagacacatccaacgagacacacgcctacatggaaactgggaaggagccgtagagatcgtagacgacgaccggccgtatatttctagcgcgagaagaacggttaaaagttgacggtggtaggttcccgggggaanacgagtcgaacgtaacgg

SEQ ID NO: 440273 - DNA, 596 bp, Homo sapiens
  misc_feature: GZ8MTXP01ANIBD.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctccgtgggtgcgacacggcccctggacaaggcttgaggtggggtggggtggtcagcgtcttacgagttggctacactaaattntgacacagaaagttccaaggacagacgtcaccatacgaccacagacacactccacgacgacacacgacctacataggaactggggaggacgccgtagacgtatcgtacgaacgaccgaccgggtaccgttacttagtttcgtcggcgaccggaagtaacggtaaacggttaaaaggttcggttaacgggttgggtacggttcccggggggaacacgttacgtaacgaaccgtaacccggg

SEQ ID NO: 440274 - DNA, 519 bp, Homo sapiens
  misc_feature: GZ8MTXP01A10XC.10.88.H11.1.454.CMB.2.raw
  modified_base (403)..(403): a, c, t, g, unknown or other
  modified_base (445)..(445): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggccccctggacaaggacttggagtggggtggggtgggtcagcgcttaccaagtttggctacacaaattatgcacagaaaagttccaaggacagagtcaccatgaccacagacacanccacgagcacagcctacatgaactggaggagcctagagatcngacgactacggccgtatattctgcgcgagagagttaaaagttgacgtggtagttcgggggacacggatcgcgcg

SEQ ID NO: 440275 - DNA, 697 bp, Homo sapiens
  misc_feature: GZ8MTXP01EDDCD.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtctttctggttacctacctttaacacctatggcatctccgtgggtcgcgacgacggccccctgggacaaaggtcttggaggtgggggtgggggtgggtcaggcgtacgttaaccgaggtttggcttaacgaactaaaattagtgaccaacgaacggtaaaacgtttcccgaagggaacaaggacgtaccaaccctaagtacgaaacccaacgaacgaaccaacaactacccgaacgaacgaccaaccgacgaccctaacaagtacggaaccgtaggggaaggacgaccgtagacgtacgttacgtacggaaccgacgtaccgggtacccgttaattagtttaaccgtcggccggacggaaaggaaacggtaaacggttaaaagggttcggttaaccgggttaagggttaacgggttccggggggaactacggacgtaaccggaaccgtaacccgggg

SEQ ID NO: 440276 - DNA, 660 bp, Homo sapiens
  misc_feature: GZ8MTXP01CCUNH.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggtcttctggttacacctttaacacctatggcatctccgtgggtgcgacgacggcccctggacaaaggtcttggaggtgggggtggggtggtcaggcgtcttaaccgaagttggactacaactaaaattatgacaacaggtaaaacgttccaagggacaagacgtacaccatcgaacccacaagaacaacactacccaacgaacgaccaacacgacctaacaagtagggaaacctagggggaacgggacgacccgtaggacgactcgaggaaccgaccgaaccggtaccgttaattacgttttaacgaggccggacggaaggaaacggtaaacggttaaaaagggttcggttaaccgggttaagggttaaccgggttaaccggggggaacaacgacgtaacggaaccgtaacccgggg

SEQ ID NO: 440277 - DNA, 546 bp, Homo sapiens
  misc_feature: GZ8MTXP01AFD9C.10.88.H11.1.454.CMB.2.raw
  modified_base (261)..(261): a, c, t, g, unknown or other
  modified_base (484)..(484): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacncctatggcatctcctgggtgcgacaggcccctggacaaggcttgagtggggtggggtggtcagcgcttaccgaagttggactacacaaattatgctacagaaacttccgaaggacagagtccaaccatacgaaccacagacacactccacgacgacacacgacctacagtacggaacgtggggaggacgccgtagagatcgtacgacgaccgacggacgtatnttctgcgcgagagaacgttaaagttgacgtggtacgtcggggacacgagtgaacgaaccggg

SEQ ID NO: 440278 - DNA, 550 bp, Homo sapiens
  misc_feature: GZ8MTXP01CYGV1.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggccccctaggaccaaagggactttggaggtgggggtgggggtgggtcaggcgacttaccgaagttggactacactaaaattatgcacagaaaagttccaaggacagagtcaccatgacccacagacacataccacgagacacacgcctacataggaactagggaggacgaccgtagagatcgtgacgacgacggaccgtatattctgcgcgagagacgttaaagttgacgtggtacgtcgggggacacgatgaacgaaccgg

SEQ ID NO: 440279 - DNA, 596 bp, Homo sapiens
  misc_feature: GZ8MTXP01CBTS9.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtcgcgacacggcccctaggacaaggacttggaggtggggtgggggtggtcaggcgtcttaaccgaaggtttggactaacgaactaaaatttatggacaacgagaaacgttccaagggtacagacgtcacatcgaccacacgacacactaccacgacgacacacgacctacagtagaacgtaggggaggacgcctagagatcgtagaccgacgacggtaccgtatacgttcgtgcgtacgaggaacgtaacggttaaaagttcggacggtaagggtacggttaaccgggggacacgacgtaacgaacgtaacccggg

SEQ ID NO: 440280 - DNA, 553 bp, Homo sapiens
  misc_feature: GZ8MTXP01E5CUC.10.88.H11.1.454.CMB.2.raw
  modified_base (351)..(351): a, c, t, g, unknown or other
  modified_base (355)..(355): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggtcttgaggtggggtgggggtggtcagcgcttacagttgctacacaattngcanagaaacgttccaaggacagagtcaccaagtgacccacagaacacatccacgacgcaacacgcctacagtaggaactggggaggagccgtagagatcgtagacgacgaccggaccgtattattctgcgacgagaacggtaacgttaaaggttgacggtaaggtacggttccgggggacacgagtcgaacgtaacccggg

SEQ ID NO: 440281 - DNA, 659 bp, Homo sapiens
  misc_feature: GZ8MTXP01AT18C.10.88.H11.1.454.CMB.2.raw
tcagcatagtagtgcacgaccggtgctcgatttagcgacagcgagaacacacaaaggggacccaaaaaccacaccctccttgggagaatccctagatcacagctcctcaccatggactggacctggagcatccttttcttggtggcagcagcaacaggtgcccatcccccccaggttcagctggtgcagtcgtggggctgaggtgaagagcccgtggggcctcagtgaagatctcctgcgaggtcttctggttactacctttaacacctatggcatctccgtgggtgcgacgacggcccctggacgaaggtacttggaggtgggggtgggggtggtcgaggcgtactttaccgaaggtttggactacaactaaattatgacaacgagtaaaacgttccaagggacaggacgtacaccatacgacccacagacacgactaccgagacgacacacgacctaacagtacggaaccgtgggggaacgggacgcccgtaggaacgactccgtacggaccgaccgtaccgggtacccgttaattacgtttcgtggccgggtacgaaggaacggtaaaccggttaaaaggttcggttaacgggttaaggggtaccgggtttaacccggggggaactacggttaacgtcggaaccgtaaccccgggg

SEQ ID NO: 440282 - DNA, 646 bp, Homo sapiens
  misc_feature: GZ8MTXP01CSU69.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccctggacaaggcttggaggtgggggtgggggtgggtcaggcgctaccgaagttggactacacaaattatgcacagaaacgttccaaggacagagtcaccatacgaccacagacaacactaccaacgagaccaacacgacctaaccaatacgggtaaacctagggggaagggtacgtaccgtaggaaggactcgtaggaaccggaccgaaccgggtaccgttaacttacgtttaactggaccggacggaaggtaaacgggtaacggttaaaaacgggttgggttaccgggttaaggggttaaccgggttaacccggggggaacaccggttagtaacggaaccgtaaccccggggg

SEQ ID NO: 440283 - DNA, 674 bp, Homo sapiens
  misc_feature: GZ8MTXP01CV04W.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttaccacctttaacacctatggcatctccgtgggtgcgacgacggccccctggacaaggacttggaggtgggggtgggggtgggtcaggcgtcttaccgaaggtttggactacaactaaaattatgcaacaagtaaaacgttcccaaggacaggacgtacaccatcgaacccacagacacactaccacgacgaccaacacgacctaacaagtacgggaaaccgtaggggaacggacggcccgtaggaagtactcgtacggaaccgaaccgaaccgggtacccgttaattaacgtttcgtacggaccggaccggaaaggtaaacggtaaacggttaaaaagggttacgggttaaccgggttaaggggttaacgggtttaacccggggggaacaacggttaacgtaacggaaccgtaaccccgggg

SEQ ID NO: 440284 - DNA, 573 bp, Homo sapiens
  misc_feature: GZ8MTXP01BD2H0.10.88.H11.1.454.CMB.2.raw
  modified_base (357)..(357): a, c, t, g, unknown or other
  modified_base (429)..(429): a, c, t, g, unknown or other
  modified_base (486)..(486): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaaggcttggaggtggggtgggtgggtcaggcgcttaaccgaagttggctacacaaattntgacacagaaacgttccaaggacagacgtcaccatcgaacccacagacacactccacgaagcacagccctanatggaactggggaaggagccctagagatccgtagaaccgacgaccgggccgttaatnttaaccgtggcgacggagaagtaacggttaaaagttggaacggtgggtaacggttccgggggaacacgataaggaaccgtaaccggg

SEQ ID NO: 440285 - DNA, 760 bp, Homo sapiens
  misc_feature: GZ8MTXP01CKG5O.10.88.H11.1.454.CMB.2.raw
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcagtgaagatctcctgcgaggtcttctggttacacctttaacacctatggcatctccgtgggtgacgacgacggccccctggacaaaggtacttggaggtgggggtgggggtgggtcaggcgtacttaaccgaaggtttcggacctaacaacgtaaaaactttntaggactaacgaaggtaaaacgttcccaagggacaaggaacgtccaaccatcgaaccaacagaacacatacccaacgacgaccaacacgacctaacaagtacgggaaaccttagggggaacgggtaacggcccgttaaggacgtaacgtccgtacggaaacccggaccgtaaaccgggggtaccctttaaagttaacgttttccgttacgggaccggtacccgggaaaggaaacggggtaaaaccgggtttaaaaaaagggttcggggttaaaacccgggggtttgggggttaaaacccgggggttttaaccccgggggggggaaactaaccgggttaaacgtttaaccggggaaacccgttaaccccgggggg

SEQ ID NO: 440286 - DNA, 693 bp, Homo sapiens
  misc_feature: GZ8MTXP01EZ3J0.10.88.H11.1.454.CMB.2.raw
  modified_base (290)..(290): a, c, t, g, unknown or other
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtgggggcctcagtgaagatcctctgcgaggtcttctggttactacctttaacacctatggctatctccgtgggtcncgacgacggcccctggacaaggacttggaggtgggggtgggggtggtcaggccgtacgtttaaccgaaggtttcggacttaacgaactaaaatttntagacaacgaacgtaaaacggttcccgaagggacaagggtacgtaccaaccgagtacgaacccaacacgaacacaactaccgacgaacgaccaacgacgtacctacaagtaacgggaacgtaggggaacggtacgaccgtaggaagacgttcgtacggaaccgtaccgaccgggtacccgttaagttaacgtttcgtcggacgggacggttaaaggaaacggtaaacggttaaaaaggttcgggttaacggttaagggtacgggttaaccgggggaacacgttacgtaacggaaccgtaacccgggg

SEQ ID NO: 440287 - DNA, 641 bp, Homo sapiens
  misc_feature: GZ8MTXP01BTFTI.10.88.H11.1.454.CMB.2.raw
  modified_base (357)..(357): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagccctgggggcctcagtgaagatctcctgcgaggcttctggttacacctttaacacctatggcatctcctgggtgcgacacggcccctaggacaaggacttggagtgggggtggggtggtcagcgcttacgagttgctacacaaattngcacagtaaagttccgaaggacaggacgtcaaccagtacgacccacacgacacactaccacgacgaccacacgacctaacagtacggaaccgttaggggaaggacggacccgtaggaagacgtcgtacgaaccggaccgtaccgggtaccgttacgttaactttcgtacggttcggacggaacggtaaacggtaaccggttaaaaggttcggttaacgggtaacggggttacgggttaacccggggggaactacggttacgtaacggttaaccgtaacccgggg

SEQ ID NO: 440288 - DNA, 548 bp, Homo sapiens
  misc_feature: GZ8MTXP01DL1IJ.10.88.H11.1.454.CMB.2.raw
  modified_base (364)..(364): a, c, t, g, unknown or other
  modified_base (482)..(482): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggccccctggacaaggacttggagtgggggtgggggtgggtcaggcgcttaccaaggtttggctacacgaaaatttntgcacagaaaagttccaaggacagagtcaccatagacccacagacaacatacccagagcaacagcctacatagaactgggaaggagcctagagatcgtagacgacaccggaccgtatnttctgcgcgagagaacgttaaaagttgacgtggtagttccgggggacacgatcgaacgtaaccggg

SEQ ID NO: 440289 - DNA, 647 bp, Homo sapiens
  misc_feature: GZ8MTXP01BN0UW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttctggttacctacctttaacacctatggctactctccgtgggtcgcgacgacggccccctgggacgaaagggtctttggagggttgggggttgggggttgggtcgaggccgtacgtttaaccgaaggtttggacctaacaacgtaaaatttgagcaacgagtaaacgttccaaggacagacgtccacatcgaccacagacacactaccacgacgcaacacgacctaacgagtaggaacgtaggggaggacgccgtaggacgtactcgtacgaccgacgtaccggtaccgttaattacttcgtcggcggacggaaaggtaacggtaaacggttaaaaggttcggacgggttaagggtacgggttaaccgggggaacacgacgtaacggaacgtaacccgggg

SEQ ID NO: 440290 - DNA, 612 bp, Homo sapiens
  misc_feature: GZ8MTXP01CL0DF.10.88.H11.1.454.CMB.2.raw
  modified_base (288)..(288): a, c, t, g, unknown or other
  modified_base (372)..(372): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtggggcctcgagtgaagatctcctgcgaggtcttctggttaccacctttaacacctatggcatctccgtgggtncgacgacggcccctggacaaggcttggaggtgggggtggggtgggtcagccgtacttaccgaaggttggactacaactaaattnagcaacgagaaacgttccaaggacagacgtacaccatcgaaccacacgacacactaccacgagacacacgacctacagtacggaacgtaggggacggacgtccgtagagacgtcgtacgaccgacgtaccggtaccgttattagtttcgtgcggacggaaggtaaggtaacggttaaaggttcggacgggttaagggtacgggttccgggggacacgacgtaacggaaccgtaaccgggg

SEQ ID NO: 440291 - DNA, 667 bp, Homo sapiens
  misc_feature: GZ8MTXP01B3Y7Z.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacacctttaacacctatggcatctcctgggtgcgacacggcccctggacaaggcttggaggtgggggtgggggtggtcaggcgtacgtttaaccgaaggtttggacttaacgaactaaaatttagtacggcaaacaaggtaaaacgttcccgaaggggaccaaaggacgttaccaacccgtaagtacggaaaccccaacgaagaaccaaccactacccacgaacgacaaccacgacctaaccagtagaaaccgtaggggaaggtacgacctagaaggactcgagaaccggacgtaccgggtaccgtattaacgtttcgtaggccgacggagtaaacggtaacggttaaaagttcggaacggttaaggggttacggttaaccggggggaacacgttacgtcggaacgtaacccgggg

SEQ ID NO: 440292 - DNA, 617 bp, Homo sapiens
  misc_feature: GZ8MTXP01DR8HB.10.88.H11.1.454.CMB.2.raw
  modified_base (288)..(288): a, c, t, g, unknown or other
  modified_base (378)..(378): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtgggggcctcgagtgaagatctcctgcgaggtcttctggttacacctttaacacctatggcatctccgtgggtcncgacgacggccccctagggacaaaggacttggaggtgggggtgggggtaggtcaggcgtcttaccgaagtttcggactacgactaaattntggacaacaggaaaacgtttccaagggacaggacgtcaaccatcgaaccacagacacatccaacgagacacacgacctacagtacggaacgtaggggaacggacgaccgtagagatcgtaggaacgacgtaccggtaccgttagttatttaacgtggcggacggaagaacggtaacgttaaaaggttgaacggttgggtaacggttccgggggacacgagtaacgaaccgtaaccgggg

SEQ ID NO: 440293 - DNA, 670 bp, Homo sapiens
  misc_feature: GZ8MTXP01D6TLU.10.88.H11.1.454.CMB.2.raw
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggtcttctggttaccacctttaacacctatggcatctccgtgggtcgcgacacggcccctggacaaggtacttggaggttgggggtgggggtggtcaggtccgtacgttaaccgaaggtttcggactaacgaactaaaatttgngacaacgagtaaaacgttcccaaggacagacgtcaaccatacgaaccacagacacactaccacgaacgccaacacgacccaacacgtacgggaacgtaggggaacgggacgtaccgtaggagtacgtccgtacggaaccgaccgtaccgggtaccgttaattcgtttaacgtcggaccggacggttaaaggaaacgggtaacggttaaaaaggttcgggttaacgggttaaggggtaacgggttaaccggggggaacacggacgttaacggaaccggtaacccgggg

SEQ ID NO: 440294 - DNA, 676 bp, Homo sapiens
  misc_feature: GZ8MTXP01D6XTH.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagagccgtggggcctcagtgaagatctcctgcgaggtcttctggttacctacctttaacacctatggcatctcgtgggtcgacgacgacggccccctaggaacaaaggtcttggaggttgggggtgggggtggtcaggtccgtacgttaaccgaggtttcggactaacgaactaaaagttatgacaacgtaaggtaaacgtttacccgaagggtaacaaggtacgtaccaaacccgtagtacgaaacccaacgaacgaaccaacactacccaacgaacgacaacacgacctaacagtacgaacgtaggggaacgggacgacccgaagtactcgacgaccgaacgaccgggtaccttaattacgtttcgaacgacggaccggaaaggaacggtaaacggtaaaagttcggacggttagggtaacgggttacgggggaactaacgagttacgaaccgaaccggtaaccgggg

SEQ ID NO: 440295 - DNA, 525 bp, Homo sapiens
  misc_feature: GZ8MTXP01B61UL.10.88.H11.1.454.CMB.2.raw
  modified_base (448)..(448): a, c, t, g, unknown or other
  modified_base (470)..(470): a, c, t, g, unknown or other
  modified_base (482)..(482): a, c, t, g, unknown or other
  modified_base (505)..(505): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgtaggtttctggttacacctttaacacctatggcatctcctgggtgcgacaggcccctggacaaggacttgagtgggtgggtggtcagcgcttacaagttggctacacaaattatgcacgagaagttccaggaacagagtcaccatgaccacagacacatccacgagacacagcctacatggaactgaggggagccgtgagatctgacgacncggtccgtatattctgcgcganagaacgtaaagnggcgttggtaagtccgggggaancattcgaacgcgtaacgggg

SEQ ID NO: 440296 - DNA, 683 bp, Homo sapiens
  misc_feature: GZ8MTXP01B9GQA.10.88.H11.1.454.CMB.2.raw
  modified_base (374)..(374): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttactaccttaacacctatggcatctccgtgggtcgcgacgacggcccctaggacaaggtacttggaggtgggggtgggggtggtcaggcgtacttaccgagtttcggactacaactaaacttntgacacgagaaacgttcccaagggacaggagtacaccgatcgacccacaagacacacgtaccaacgacgaccaacacgacctacagtacggaacgtaggggaacgggagtcccgtaggaacgacgttaccgtacggaaccgaaccggtaaccggggtacccgtttaattacgttttaaccgtcggaccggtaaccggaaaggtaaacgggtaaaccgggttaaaaagggttcggttaacgggtttaacggggttaacgggttaacccggggggaactaccggttagtaacggaacccggtaacccgggg

SEQ ID NO: 440297 - DNA, 682 bp, Homo sapiens
  misc_feature: GZ8MTXP01BDMC2.10.88.H11.1.454.CMB.2.raw
  modified_base (378)..(378): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgaggtcttctggttacctacctttaacacctagtggcatctccgtgggtgcgacgcggccccgtggacaaggcgttggaggtgggggtgggggtggtcaggccgtcttaaccgaagttcggactaacgaactaaattntacgacaacgaggtaaaacggttcccgggaacagtacgtaccaaccgatacggaaccaacaacgaacaacactaccgaacgacgaccaacgacgacctaacgacgtacggaacgtaggaacggggacgtccgtagagtacgtacgtacgaaccgaccgtaccggtaccgttaagtttacgtttcgtcggacggttacggaaacggaaaggtaaaccggttaaaaggttacggttacggttacgggttaacgggttaccgggggaactacggacgttacggtaaccgttaaccgggtaaccgggg

SEQ ID NO: 440298 - DNA, 684 bp, Homo sapiens
  misc_feature: GZ8MTXP01CO8OZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggcttctggttacacctttaacacctatggcatctccgtgggtgcgacacggcccctggacaaggcttggaggtgggggtggggtggtcagcgtcttaccgaaggtttcggactacaactaaattatagacaacgaggaaaacgtttcccaagggtaccaaggaacgttcaaccatcgaaacccacaagacaacactaccaacgacgacaacacgacctaacaacgttagggaaacgtaggggaacgggaacgaccgtagaacggatacgtacggaaccgaacgaaccgggtacccgtaaagttacgtttaacgttcggaccgggtaccggaaacgggaaaggtaaccggttaaaaagggttcggttaaccgggttaaggggttaacgggtttaacccgggggggaacgacggttaacgttaacggaacccgtaaccccggggg

SEQ ID NO: 440299 - DNA, 788 bp, Homo sapiens
  misc_feature: GZ8MTXP01CXTML.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctgagtgaagatctccgtgcgaggtcttcgtaggttaacctaacctttaacacctagtcggctatcctcgtgggtcgacgaccgacggcccccgtaggaaccgaaagggtcgtttagggaggggtggggggttgggggttgggtacgacggtccggttaccgttaaccggtaaaggtttcgggacttaaaccgaacgttaaaaagtttcgtacggacctaaacgtaaggttaaaaacggttaccccgaaggggtaacctaaagggtaaccggttacccaaacccgtaagtaccggaaaccccaacgaacgaaccaaccgaactacccgaacgaacgacaaccacgacctaacagtacggaacgtggggaacggacgtaccgtaggaacgacgtacgtacggaaccgacgtaccgggttaccgttaattacgtttcgtacggaccgggacgaaagggtaaacggtaaacggttaaaacgggttacggttaacggggtttaacggggtaacggggtttaacccggggggaaacttacgggaacgttaaccggaacccggtaacccgggg

SEQ ID NO: 440300 - DNA, 728 bp, Homo sapiens
  misc_feature: GZ8MTXP01D4YFM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacaccttaacacctatggcatctccgtgggtgcgacgacggccccctgggacaaggacttggaggttgggggtgggggtggtcaggcgctttaccgaggttggctacgaactaaattatgacacagtaaaacgttccgaagggaccaaggacgtacaaccatacgaacccaacgacgaacacactacccaacgaacgaccaacacgacccttaacagtagggaaccgtagggggaagggacggtaccctagggaacggtaactcgtacggaaccggaaccgtaccggggtacccggttaattacgttttccgttacgggaccgggtaaccgggaaagggtaaacgggtaaaacccgggtttaaaaaagggttcggggttaaaccgggggtttaacgggggtttaaaccgggggtttaaccccgggggggggtaaactaccggaacggtttaaccgggaacccgggttaacccccggggg

SEQ ID NO: 440301 - DNA, 649 bp, Homo sapiens
  misc_feature: GZ8MTXP01EDAXC.10.88.H11.1.454.CMB.2.raw
  modified_base (261)..(261): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggcttctggttacacctttaanacctatggcatctccgtgggtgcgacacggcccctagggaacaaggtacttggaggttgggggtgggggtggtcaggtcgtcttaaccgaaggtttggacctaacaactaaaattatgctaaacgaggtaaaacgttcccgaaggggtacaagggaacgtccaacctatacggaaaccaacaagaacacactaccaacgaacgacaacacgacctaacagtaggaacgtggggaaggacggcctagagatcgtagaacgacgtacggtaccgtattacgttaactcgacggacgaaggaacggtaaacggttaaaaggttcggttaacgggttaagggttaacgggttaaccggggggaacacgacgtaacggaaccggtaacccggg

SEQ ID NO: 440302 - DNA, 682 bp, Homo sapiens
  misc_feature: GZ8MTXP01EEC5F.10.88.H11.1.454.CMB.2.raw
  modified_base (437)..(437): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtgggggcctcgagtgaagatctcctgcgaggtcttctggttacctacctttaacacctatggcatctccgtgggtcgcgacgacggccccgtggacaaggacgttggaggttgggggtgggggtggtcaggtccgtacgtttaaccgaggtttcggactaacgaactaaattatgactaacgaaggtaaacgttccgaaggacaagacgtcaccatagaccanacgacacacgaccacgagacacacgcctaacgagtacggaacgtagggggaacgggacgtaccgtaggaagtacgtacgtacggaaaccgacgtaaccgggtccggttaactttacgtttcgcggttcgggaaccggttaagtaaacggtaaacgggttaaaagggttcggttaacccgggttaaggggttaaccgggttaaccggggggaacaccggttagttaacggaaccggtaacccgggg

SEQ ID NO: 440303 - DNA, 682 bp, Homo sapiens
  misc_feature: GZ8MTXP01D5HUS.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtgggggcctcagtgaagatctcctgcgaggtcttctaggttacctaacctttaacacctagtggcatctccgtgggtcgcgacgacggcccctaggacaaggtcttggaggtgggggtggggtggtcaggcgtacttaaccgaaggtttcggactaacgaactaaattgtaggaccaacgaaggtaaaacgttcccgaaggggaacaaggtacgtaccaaccatacgaacccaacgaacgaacaacactaccgaacgaacgacacacgtaccaacagtaggaacgtaggggaacggacgtaccgtagagtacgtcgtacggaacgacgtaccggtaccgttacttagtttaacgtcggacgacggaaaggtaaacggtaaacggttaaaaggttcgggttacgggttaaggggttaaccggttaaccggggggaacacggttacgtaacggttaaccgtaacccggggg

SEQ ID NO: 440304 - DNA, 717 bp, Homo sapiens
  misc_feature: GZ8MTXP01A7A9A.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctccgtgcgaggtcttctggttactacctttaacacctatggcatcctccgtgggtcgcgacgacggccccgtaggaacaaggtacttggagggttgggggtagggggtgggtcgaggtccgtacgttaaccgtaaggtttcggactaaacgaactaaaagtttagtacgacaaacgtaaggtaaaacgtttacccgaagggaaccaaggacgtaccaaccgatacgaaccaacacgaacacactaccaacgacgacacacgacctaacagtagaaccgtaggggaacggacgacccgtaggaagtacgtaccgtacggaaccgaccgtaacccgggtacccgttaattcgtttaaccgtcggaccggtaccggaaaggtaaacggtaaacgggttaaaaggttcgggttaaccgggttaagggttaacggggttaacccggggggaacaacggttacggtaaccggaaccggtaacccgggg

SEQ ID NO: 440305 - DNA, 618 bp, Homo sapiens
  misc_feature: GZ8MTXP01A91BU.10.88.H11.1.454.CMB.2.raw
  modified_base (193)..(193): a, c, t, g, unknown or other
  modified_base (296)..(296): a, c, t, g, unknown or other
  modified_base (407)..(407): a, c, t, g, unknown or other
  modified_base (573)..(573): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccacctgttcttttcnccaggggacagagtccaccctctcctgtagggccagttatggtgttggcgtccttaatttaaactggtaaccaacagaaacgtggccaggctccaggctcctnatctacgagcatcccacagggccacgtggcctcccagccctagggttcgatcggcagggtgggtcctggggacaggtaccttcaactctcacatcagcacgcctagggacnccgtagaacgtattattggacttaagtttattagttgtacagacaggtcggttaagcgtagggtcggtccttcgtaccgtttcggggaccccggggtaactaaaagggtacggtaaaacttaccggaaaacgtaacgttgggtacgggcctaggtccaaaccgttnttcgttaacgttccttcgtacttccgttcccctcttaacgtttcc

SEQ ID NO: 440306 - DNA, 533 bp, Homo sapiens
  misc_feature: GZ8MTXP01AUFR7.10.88.H11.1.454.CMB.2.raw
  modified_base (357)..(357): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactgtacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtggggtgggggtgggtcaggcgcttaccgaagttggctacacaaattngcacagaaacgttccaaggacagagtcaccatgaccacagacacatccacgagacacacgcctacataggaactggggaaggagcctagagatctagacgacgacggtccgtatattctgcgcgagagaacgttaaagttgacgtggtagtcgggggacacgagtcgaacgaacgg

SEQ ID NO: 440307 - DNA, 690 bp, Homo sapiens
  misc_feature: GZ8MTXP01AJJLJ.10.88.H11.1.454.CMB.2.raw
  modified_base (236)..(236): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgggagagagccgtcgggcgtcagtgagatctcctcgcgnggcttctgttacgtaccttaactactatggcgatctccgtgggtggcgacgacggccccgtggaacgaaggtacgttggtaggtgggggttgggggtggggttcgacggcgtccgttaccgtaaggttgggcttaacaacgtaaatttaagtcgacaacgaagaacgttaaccaccgggaagtacgaggtacaccgatacgaccaacagactacatcccacgagaccacacgcctaactagtacggaacgtaggaggggggaccgtcttcggaaagaacgttccgtaggaccccggaaacggttcccgggacccggtttaattttaacgtttccaaggggcccgaaggggtaaacgacggttaaaacgggttaaagttcgggttaccgggttggtttaaccgggggtaccgggggaacactacgttcggggaacttaacccgggtaaccggggg

SEQ ID NO: 440308 - DNA, 680 bp, Homo sapiens
  misc_feature: GZ8MTXP01BCOSJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgagagcccgtggggcctcagtgaagatctcctgcgaggtcttctggttactacctttaacacctagtggcatctccgtgggtgcgacacggccccctggacaaggcttggaggtgggggtgggggtggtcaggcgtacgtttaccgaaggtttcggactacgaactaaaatttgtacgacaacgaaggtaaaacgtttacccaaggggtaccaaggtacggtacccaaccgtaatcggaaacccaacgaacgaaccaacaacgtacccaacggaacgaccaacaacgaccttaacagttagggaacctaggggaaggacggcctaggagtatcgtaggaaccgacgtaccgggtaccgttattagtttcgtggttcggaccggaaggaaacggtaaacggttaaaaggttgggttaccgggttaagggtacgggttaaccggggggaacacgacggttaacggaaccgtaacccgggg

SEQ ID NO: 440309 - DNA, 663 bp, Homo sapiens
  misc_feature: GZ8MTXP01ELAEI.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctccgtgggtcgacgacgacggcccccgtaggaacgaaaggtcgttggagggttgggggtagggggtgggtcaggccgtacttaaccgaaggtttcggactaacgaactaaatttatcggacaacgtaggtaaaacgttccgaaggacaagggactaccaacatacgaaccacaacgacacactaccacgacgacacacgacctaacagtaacgaacgtaggggaaggtactaccgtagaagtactcgtacgaaccggaccgtaaccgggtaccttaacttacgtttcgtcggaccggacggttaaggaacggtaaacggttaaaaggttcggttacggttaagggtacggtaaccgggggtacacgagtaacgaaccgtaacccgggg

SEQ ID NO: 440310 - DNA, 725 bp, Homo sapiens
  misc_feature: GZ8MTXP01B6A67.10.88.H11.1.454.CMB.2.raw
  modified_base (387)..(387): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttacaccttaacacctatggctatccgtccgtgggtcgcgacgacggccccctaggaaccgaaagggtcttggaggttgggggtgggggtggtcgaggtccgtactttaccgaggtttcggactaacaactaaattntggacacgaaggtaaacgttcccgaaggggacaaggacgttacccaacctagtacgaacccacacgaccacactaccgacgacgacaacgacgacctacagtacggaacgtagggggaacgggacggtacccgtaggacgtacgtacgtacggaaccggaaccgtaccgggtaccgttaacgtttacgtttccggttcggaccgggtaccggaaggtaaacgggtaaaccgggttaaaagggttacgggttaaccggggttaaggggttaaccggggtttaacccggggggggaacctacggttaacggtaaccggttaacccgggtaaccccggggg

SEQ ID NO: 440311 - DNA, 682 bp, Homo sapiens
  misc_feature: GZ8MTXP01ARHW3.10.88.H11.1.454.CMB.2.raw
  modified_base (594)..(594): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttcgtggttacctacctttaacacctagtggctatctccgtgggtcgaccggacgacggcccccgtagggaaccgaaagggtaccgtttggagggttcgggggtaggggggttcgggtcgaaggtccggtacctttaaccgaaaggtttcggacttaacgaactaaaatttgtgaccaacgaaggtaaaacgttcccgaagggaacaggacgtaccaccagtacgaacccacaacgaacacactacccgaacgacgacacgacgacctaacgagttacggaaccgtaggggaacggacgccgtaggagtacgtcgtagaaccgacgtaccgggtaccttattacgtttcgngttccggacgaaggaaacggtaacgttaaaaggttcggacggttaagggtacggttccgggggacacgagtcggaaccgtaaccgggg

SEQ ID NO: 440312 - DNA, 640 bp, Homo sapiens
  misc_feature: GZ8MTXP01A2Y9W.10.88.H11.1.454.CMB.2.raw
  modified_base (399)..(399): a, c, t, g, unknown or other
  modified_base (519)..(519): a, c, t, g, unknown or other
  modified_base (525)..(525): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggcgtgaggtgaagagccctggggcctcagtgaagatctcctgcgaggcttctggttacacctttaacacctatggcatctccgtgggtgcgacgacggcccctggacaaggcttggaggtggggtgggggtggtcagcgcttaccgaaggttggctacgactaaattatgcaacagtaaacgttccaagggacaggagtcaaccntacgaccacacgacacataccgacgacgacacgacgcctaacgagtacggtaaccgtaggggaacgggaggtcccgtaggagaactcgtacggaacggaccgaccgggtaccgtacgttntttcgnggttaccgacggagtaaacggtaacggttaaaacggttcgggttaacgggttaagggggttaacgggttaacccggggggaacacggttacgttaacggaaccgtaacccggggg

SEQ ID NO: 440313 - DNA, 539 bp, Homo sapiens
  misc_feature: GZ8MTXP01AI8T9.10.88.H11.1.454.CMB.2.raw
  modified_base (327)..(327): a, c, t, g, unknown or other
  modified_base (496)..(496): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtggggtgggtggtcaggcgnttaccgaagttggctacacaaattatgctaacagaaacgttccaaggacagagtcacatgaccacagacacatccacgacgacacagacctacatagaacgtggaaggagccgtagagaatcgtgacgacacggtaccgtatattctggcgcgagaagacgttaaaggngaacggtggtacgttcgggggacacgagtcgaacgtaaccggg

SEQ ID NO: 440314 - DNA, 624 bp, Homo sapiens
  misc_feature: GZ8MTXP01BBOT2.10.88.H11.1.454.CMB.2.raw
  modified_base (475)..(475): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggggctgaggtgaagagccctgggggcctcagtgaagatctctgcgaggcttctggttacacctttaacacctatggcatctcctgggtgcgacaggccccccgtagaacggaacgtgtagtggggtgggggtgggggtcgtacgacgccgttaacctaacgttaggtcgtaactaacaaaacttaaattgacgacaagaaagtaaacccgtaacggaacgaacgaaaggtacaaccaactagacaacccagaacacaactacaccaagacacagacaccaanagaacgacgaggggacgcgacgacgactctcgacgaaccgaccgtaccgtactattcgtcgcgcgaaggaaagaaacggtaaaagttaaggacggttacgggtaaggtaccggggtaaccggaacacgacgtaaccgaaccgtaacggg

SEQ ID NO: 440315 - DNA, 748 bp, Homo sapiens
  misc_feature: GZ8MTXP01DLR1Y.10.88.H11.1.454.CMB.2.raw
  modified_base (296)..(296): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtctggggctggaggtgaagagcccgtggggcctcgagtgaagatctcctgcgaggtcttcgtaggttaacctaacctttaacacctatggctatcctccgtgggtncgacgacggcccctaggacaaggtcgttggaggtgggggtgggggtggtcaggtcgtaccgttaaccgtaggtttcggactaaacaaactaaaacgtttgtagacctaacgtaaggtaaaacgttacccgaagggtaacaagggtacgtaccaaccaagtacgaaacccaacaacgaacaacactaccgaacgacgaccaacacggacctaaacgtagtacgggtaaaccgtaggggaacggtaacggtacccgtaaggaacgtaacgttccgtacggaaacccgacggtaaccccggtaccgtttaaacgttaacgttttccgtacgggaccggtaaaccggaaaggtaaacggtaaaccggttaaaaagggttcggttaacggggtttaacggggtaacggggttaacccgggggtaacacgttacgtaacggaaccgtaaccccggggg

SEQ ID NO: 440316 - DNA, 718 bp, Homo sapiens
  misc_feature: GZ8MTXP01BT7VI.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatctcctgcgaggtcttcgtggttaccacctttaacacctatggcatctcgtgggtgcgacgacggcccctaggacgaaggtcttggaggtgggggtgggggtgggtcgaggccgtacttaccgaaggtttcgggactaacgaactaaaacgtttagtacggactaacgaaggtaaaacgtttacccgaagggggtaaccaaagggtaacggttacccaaaccccgtaagttacggaaaccccaacgaacggaaaccaaccaactacccgaaacggacgtaccaaaccgacgacccttaaacgaacgtaagggaaccttagggggaacggacgcccgtagagactacgtagaaccggacgacccgggtaccgttaagttactttcgtacgccggacggaaggtaaacggtaaacgttaaaagggttggttaaccgggtaaggtacgggttaaccgggggactaccggagtaacgaaccgtaaccggg

SEQ ID NO: 440317 - DNA, 796 bp, Homo sapiens
  misc_feature: GZ8MTXP01AVV9Q.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctccgtgggtcgcgacgacggccccctaggacaaggtcttggaggtgggggtgggggtggtcaggccgtacgtttaaccgaaggtttcggactaacgaaacgtaaaatttacgtacggtaccaaaccgtaaggtaaaaaaccggtttaccccgaagggggtaaacctaacggggtaaacggttaccccgaaacccctaaagttaccgggaaaccccaaacgaaaccggaaaccaaaccaaaccgtacccaaaccggaacggacccaaccgaacggtaccccttaacgaacgttacgggaaaccgttagggggaacgggaacggtacccgtaggaacgtaacgtccgtaacggaacccggaaccgtacccgggtacccggttaatttacgttccgtacgggaccggtaccggaaaggaacgggtaaaaccgggttaaaagggttcgggttaacggggttaagggttaaccggggttaaccggggggtaaccacggacggttaacggaacccgtaacccggggg

SEQ ID NO: 440318 - DNA, 663 bp, Homo sapiens
  misc_feature: GZ8MTXP01ADTXK.10.88.H11.1.454.CMB.2.raw
  modified_base (296)..(296): a, c, t, g, unknown or other
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacgcccgtggggcctcagtgaagatctcctgcgaggtctttctggttaacctacctttaacacctatggcatcctccgtggggtcnccggacgacggcccctaggaaccaagggtcttggaggggttgggggtgggggtggtcaggccgtacttaaccgaagtttggacttaacgaactaaatttngacaacgaggtaaaacgttcccaagggacaagtacgtccaccatacgaacccacaagacacactaccacgacgacacacgacctacgagtacggaacgtaggggaggacgccgtagacgacgtcgacgaaccggaccgaccggtaccgttattactttcgtcggaccggacgaaaggaaacggtaaacggttaaaaggttcggttacgggttaagggttacgggttaaccgggggaacacgttacgtaaccggaacgtaacccgggg

SEQ ID NO: 440319 - DNA, 715 bp, Homo sapiens
  misc_feature: GZ8MTXP01EOCP9.10.88.H11.1.454.CMB.2.raw
  modified_base (230)..(230): a, c, t, g, unknown or other
  modified_base (236)..(236): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgcccgtgggcctcagtgaagntctccngcgaggtcttcgtggttaccaccttaacacctagtcgctactctccgtgggtgccgacgacggcccctaggacaaggtacgttggaggttgggggtgggggtggtcaggtccgtacttaaccgagtttcggactaaacgaactaaatttgagaccaagtaacggtaaacgttaccgaaggacagacgtacaaccagtacgaaaccacgagaaccacactaccgaacgaacgaccaacacgtacctaacgaacggtaacggaaaccgttgggggaaacggacgtaccgttagggaacgtacgttaccgtaacggaacccggaacgtacccggggttaacctttaagttccgtttaaccgtcgggaccgggtaacgggaaaaggtaaacgggtaaaaccggttaaaagggttcggttaacgggttaaggggttaccgggtaaccggggtaacacgttagtaaccggaaccgtaaccggggg

SEQ ID NO: 440320 - DNA, 691 bp, Homo sapiens
  misc_feature: GZ8MTXP01AC8SV.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttcgtggttacacctttaacacctatggcatctccgtgggtcgcgacgacggcccctaggacgaaggtacttggaggttgggggtgggggtgggtacgaggcgtccgtttaaccgaaggtttggaccttaacaactaaaagttatggacaacgaaggtaaaacgttcccgaagggtaacaagggacgtaccaacccgtagtcgaaacccaacgaacgaaccaacaactacccgaacgaacgaccgaacacgaccttaacaacgtacgggaaccgtaggggaacgggacgtaccgtaggaacgtacgtcgtacggaaccgaaccgaccgggtacccgttattacgtttcgtcggccggacggaagtaaacggtaaacgttaaacgggttcggttacggtggggtacggttaaccgggggaacaccgagtaacgaaccgtaacccgggg

SEQ ID NO: 440321 - DNA, 556 bp, Homo sapiens
  misc_feature: GZ8MTXP01BTUN3.10.88.H11.1.454.CMB.2.raw
  modified_base (367)..(367): a, c, t, g, unknown or other
  modified_base (493)..(493): a, c, t, g, unknown or other
  modified_base (537)..(537): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggtcttctggttacacctttaacacctatggcatctccgtgggtgcgacacggccccctggaccaagggacttggaggtgggggtgggggtgggtcaggcgcttaccgaagttggctacactaaattntgcacagaaacgttccaaggacagagtcaccatcgaccacacgacacactaccacgacgacaacacgacctacagtaggaactggggaggagcctagagatctgacgacgtacggcctattattcngcgcgagagaacgttaaagttgacggtggtacggtccggggganacgagtgaacgtaaccggg

SEQ ID NO: 440322 - DNA, 537 bp, Homo sapiens
  misc_feature: GZ8MTXP01CMS47.10.88.H11.1.454.CMB.2.raw
  modified_base (352)..(352): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctctgcgaggcttctggttacacctttaacacctatggcatctcctgggtgcgacaggcccctggacaaggacttgagtggggtgggggtggtcagcgtctaccaagttggctacacaaattntgcacagaaagttccaaggacagagtcacatgaccacagacacataccacgagacacacgacctacataggaactgggaggagccgtagagtatcgtagacgacacggaccgtatatttctgcgcgagaagaacgttaaagttgacgtggtacgttcgggggacacgagtcgaacgtaacccggg

SEQ ID NO: 440323 - DNA, 637 bp, Homo sapiens
  misc_feature: GZ8MTXP01D4KK9.10.88.H11.1.454.CMB.2.raw
  modified_base (275)..(275): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctgggcatccttttcttggtggcagcagcaacaggtgcccactcccaggttcagctggtgcagtctggggctgaggtgaagagccctggggcctcagtgaagatctcctgcgagggcttctggttaacacctttaaacacctatggcatcnccgtgggtgcgacacggcccctggacaaggacttggaggtgggggtggggtggtcaggcgtcttaaccgaaggtttggactaacacaaaatttactggacaacgagtaaagttcccaagggcagaacgtcaaccatcgaaccacacgacacactaccacgagaccacacgacctaacacgtaggaacgtaggagggggacgccgtagacgacgtactaggaaccgaacgacggtaccgtaacgttacgtttctcggtacgaccgaaggaaacggtaaaccggtaaaaggttacgggacggttacgggttaacgggttaccggggggaacacgagttacggaaccgaacccggtaaccggggg

SEQ ID NO: 440324 - DNA, 697 bp, Homo sapiens
  misc_feature: GZ8MTXP01ECX1T.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctccgtggggtcgccgacgacgggccccctagggacaaagggtcttggagggttgggggtgggggtgggtcaggccgtcttaaccgaaggtttcggactaacgaactaaaatttactagaccaacgaaggtaaaacgttcccgaagggacaaggtacgtaccaaccgaagtacgaacccaacgaacgaaccaacaactacccgaaacggaacgaccaacgacgacctaacagtacggaacgtgggggaggacgaccgtagacgtaacttccgaacggaccgacgtaccggtaccgtttaattacgtttcgcggcggaacggaaggtaaacggtaaaacggttaaaaggttcggttaacgggttaaggggttaccgggttaaccgggggaaccagttaacggtccggaaccggtaacccgggg

SEQ ID NO: 440325 - DNA, 559 bp, Homo sapiens
  misc_feature: GZ8MTXP01EV3M7.10.88.H11.1.454.CMB.2.raw
  modified_base (337)..(337): a, c, t, g, unknown or other
  modified_base (352)..(352): a, c, t, g, unknown or other
  modified_base (359)..(359): a, c, t, g, unknown or other
  modified_base (516)..(516): a, c, t, g, unknown or other
  modified_base (539)..(539): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgccgacacggccccctgggaccaagggcttggaggtggggtgggggtggtcagcgnttaccagttgactanacaattngcacagaaacttccaaggacagacgtcaaccatagacccacagacacactaccacgagaccaacacgacctaacataggaactaggggaggaagcccgtaggacgtacgtctaggacgacgacggccgttatattctgcgcgagagaacgttaaagngacggtggtacgttccggggganacgatcggaacgtaaccggg

SEQ ID NO: 440326 - DNA, 536 bp, Homo sapiens
  misc_feature: GZ8MTXP01DNHJ1.10.88.H11.1.454.CMB.2.raw
  modified_base (471)..(471): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggtcttctggttacacctttaacacctatggcatctcctgggtgcgacaggcccctggacaaggacttgagtgggggtggggtggtcaggcgcttaccgaagttggactacacaaattatgcacagaaagttccaaggacagagtcaccatgaccacagacacatccacgagcacacgcctacatagaactgggaggagccgtagagatcgtgaacgacgacggaccgtatnttaactgcgcgagagtaacgttaaagttgacgtggtagttcgggggacacgatcgaacgaaccgg

SEQ ID NO: 440327 - DNA, 609 bp, Homo sapiens
  misc_feature: GZ8MTXP01CS00E.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcagtgaagatctcctgcgaggtcttctggttacacctttaacacctatggcatctccgtgggtgcgacacggcccctggacaaggacttggaggtggggtggggtggtcagcgtcttaccgagttgactacactaaattatgcacaagaaacgttccaaggacagacgtcaccatacgacccacagacacactccacgagacacacgcctacacgtagaacgtggggacggagccgtagacgagtacgtagaaccgacgtaccggtcccgttattacgtttctcggcgacggaggaaacggtaaggttaaaacggttcggttaaccgggttaagggttaacgggttcccggggggaactacgacgttaacggaaccgtaacccgggg

SEQ ID NO: 440328 - DNA, 779 bp, Homo sapiens
  misc_feature: GZ8MTXP01C3KGV.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattcctttttcttggtggcagcagcaacaggtcgcccactcccaggttcagctggtgcagtcgtggggctggagggtagaaggacgcccgtgggggccctcgagtagaagactcctccgtgcgaggtcttcgttggttaacctaacctttaacaccttagtggctatccgtcgtgggtcgacgacgaccggccccctaggaacgaaaggtcgttggaggggtgggggtgggggtaggtcaggccgttacgttaaccgtaaggttcggacctaaacaactaaatttgacgactaaacgaaggtaaaaccgttccgaagggaacaggtaacgtaccaacctaatacgaaacccaacgaacgaacaacaactacccgaacgaacgaccaacgaaccgaccttaacgaacgtaacggtaaaccgtagggggaaacggaacggtaccgttaaggaaagtacgtacgtaacggaaacccggaaccgtaaccgggtaccgttaacgtttacgtttaaccgtcgggacgggtaaccggaaagggtaaacgggtaaacggttaaaaacgggttcggttaacggggttaacgggttaaccggggttaaccggggggaaactacggttaacggttaaccggaaccggttaaccccggggg

SEQ ID NO: 440329 - DNA, 732 bp, Homo sapiens
  misc_feature: GZ8MTXP01ALT6I.10.88.H11.1.454.CMB.2.raw
  modified_base (223)..(223): a, c, t, g, unknown or other
  modified_base (432)..(432): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctnagtgaagatctcctgcgaggtcttcgtggttacctacctttaacacctatggctatcctccgtgggtcgaccgtaccgacggtccccccgtagggaaccgtaaaggggtacctttagggaggggttggggggttgggggggttcggggtaccgagggtccggtacctttaacccggtaaaggtttcgggactaacgaactaaaatttgngacaacgaaggtaaacgttcccgaaggtacaaggtacgtaccacctagtacgaaacccagaacgacacacgtacccaacgacgaccaacacgaccttaaacgaaggtacggaaaccgttagggggaacgggacgtccgtaggacgtaagttccggacgaacccggtaaccggtccgggtacccttaagttcgtttaacgtcgggaccgtacggaaggtaacggtaaaggttaacggttacggttacgggttcgggtacgggttccggggaacgggacacggtcgaaccggtaaccccggg

SEQ ID NO: 440330 - DNA, 724 bp, Homo sapiens
  misc_feature: GZ8MTXP01CPCZO.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatctcctgcgaggtcttcgtggttacctacctttaacaccttagtggctactctccgtggggtgccgacgacggccccctagggacaagggtcttggaggtgggggtgggggtgggtcaggtccgtcgttaaccgaaggtttcggaccttaacaacgtaaaatttagtcggacaacgaggtaaaacgtttcccgaaggacagacgtcaaccatacgaccacacgacacactaccaacgagaccacacgacctacgaacgtacgggaaccgtagggggaacggacgtaccgtaggaacgtacgtacgtacggaaccggaaccgtaaccgggtacccggttaattacgtttcggtacggaccggtaccgggaaggtaaacggtaaacgggttaaaagggttcgggttaaccggggtttaacgggggttaaccggggtttaaccggggggggaacctaccggttaacggttaaccgggaaccggtaaccccggggg

SEQ ID NO: 440331 - DNA, 700 bp, Homo sapiens
  misc_feature: GZ8MTXP01DO7A9.10.88.H11.1.454.CMB.2.raw
  modified_base (225)..(225): a, c, t, g, unknown or other
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagagcccgtggggcctnagtgaagatctcctgcgaggtcttctggttaccacctttaacacctatggcatctccgtgggtgcgacacggccccctagggaacaaaggacttggagggtgggggtgggggtggtcaggcgtacttaaccgaaggtttcggactaacaactaaaatttanagactaaacgaaggtaaaacgttacccgaagggaaccaagacggtaccaaccatacgaacccaacaacgaacaacacgtaccaacggacgacaacacgtaccaacagtaggaaacgtggggaaggaagccgtaggaagaattcgtaggaaaccgacgaaccgggtaccgtaacttatttccgtggaccggtaacggaaaggaaaagggtaaaaccggttaaaaaagggttcgggttaaacgggttaaggggttaaaccggggtttcccggggggaaactaaccggacgttaacgggaacccgtaaccccggggg

SEQ ID NO: 440332 - DNA, 539 bp, Homo sapiens
  misc_feature: GZ8MTXP01AGMHS.10.88.H11.1.454.CMB.2.raw
  modified_base (357)..(357): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccctggacaaggcttggaggtggggtggggtggtcagcgcttaccgaagttggactacacaaattngacacagaaacgttccaaggacagagtcaccatcgaccacagacacactccaacgacgacacacgacctacagtagaactagggaggagccgtagagactcgcgacgacgacggaccgtatattctgcgcgagagaacgttaaagttgacgtggtacgtcggggacacgatcgcgtaaccgg

SEQ ID NO: 440333 - DNA, 648 bp, Homo sapiens
  misc_feature: GZ8MTXP01EMXCJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagagcccgtggggcctcagtgaagatctcctgcgaggtcttctggttacacctttaacacctatggcatctccgtgggtgcgacacggcccctggacaagggacttggaggtgggggtgggggtggtcagcgtacttaccgaagttggactaacaactaaaattatgacaacaaggtaaaacgttccgaagggaacaaggacgtaccaacccagtacgaacccaacaacgaacaacactaccaacgaacgacaacacgacctaacaagtaacggaacgtaggggaacggacggaccgtagaagactcgtacgaacgaccgacggtaccgtaacttacgtttcgtgacggacggaagaaacggtaaacggttaaaaggttcggttaacggtaaggggttacggttaaccggggggacacgagtaacggaaccgaaccgggg

SEQ ID NO: 440334 - DNA, 795 bp, Homo sapiens
  misc_feature: GZ8MTXP01D45WC.10.88.H11.1.454.CMB.2.raw
  modified_base (393)..(393): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcacttcctttttcttggtggcagcagcaacaggtcgcccactcccaggttcagctggtgcagtcgtggggctggaggtgaagacgcccgtggggcctcgagtgaagatctcctgcgtagtcttctcggttacctacctttaacaccttagtcggctatcgtccgtgggtcgacgacgcggccccgtaggacgaagggtcttggaggggtgggggtgggtggtcaggtccgtacttaacgaggttcgactaacaactaaactttnaggacaacgtaaggtaaaccgttccgaagggtacagtaaccgtaccaacccgataccggaaaccacaacgaaccaacactaacccgaacgaacgaccaacacggacccttaaacgacgtaaggtaaccgtagggggaaacgggtacgttaccgaggtaacgtacgtaccgttaacggaaacccgtacccggtaaccggggttacctttaagtttaaccgtttcggttaacggttacccggggaaacgggttaaacgggaaaccggggttaaaaacggggttaaaaacgggttccggggttaaaaccgggggtttaacgggggttaaacccggggtttaacccggggggggaaacctacggttaccgggtttaaaccgggaaccccgggttaaccccgggggg

SEQ ID NO: 440335 - DNA, 638 bp, Homo sapiens
  misc_feature: GZ8MTXP01CY7PX.10.88.H11.1.454.CMB.2.raw
  modified_base (141)..(141): a, c, t, g, unknown or other
  modified_base (234)..(234): a, c, t, g, unknown or other
  modified_base (469)..(469): a, c, t, g, unknown or other
  modified_base (494)..(494): a, c, t, g, unknown or other
  modified_base (554)..(554): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattcctttttnttggtggcagcagcaacaggtgcccactcccaggttcagctggtgcagtcgtggggctggaggtgaagacgcccgtggggcctcgagtgaagntctcctgcgaggtcttctaggttactacctttaacacctagtcggctatcctccgtgggtcgacgaccgacggccccgtaggaaccgtaaaggtcgttggaggttgggggtgggggtcggtcgagtcgtacgttaaccgaggttcggactaaacgataaaattgagacaagtagaaaacggttaccaagggtacaaaggacgtaccaacaagtcgaaacccagaacacaacaacnccgaacgacgacaacgacgaccaanacgtagaacgtaggggacggaacgccagacgatcgacgacgacgtacggtacctatgttngaccggagagaagtaaggttaaaagttcggaacgggttgggtacggttaaccgggggaacacgacgtcggaacgtaacccgggg

SEQ ID NO: 440336 - DNA, 605 bp, Homo sapiens
  misc_feature: GZ8MTXP01A4AZ2.10.88.H11.1.454.CMB.2.raw
  modified_base (506)..(506): a, c, t, g, unknown or other
  modified_base (531)..(531): a, c, t, g, unknown or other
  modified_base (535)..(535): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatctcctgcgaggtcttctggttaccacctttaacacctagtggctatcctccgtgggtcgcgaccacggcccctggacaagggactttggaggtgggggtgggggtggtcaggcgtacgtttaccgaaggtttcggacttacaactaaatttataggaccaacgaggaaaacgtttcccgaagggaaccagtacgaccacatcgaacccaacaacgacacacacccacgacgacacacgacctacaagtagaacgtaggggaggagccgtaganagtcgtagacgacgacggcgttatnttcngcgcgagaagtaacgttaaagttggacggtggtacggtccgggggactacgagtcgaaccggtaaccggg

SEQ ID NO: 440337 - DNA, 667 bp, Homo sapiens
  misc_feature: GZ8MTXP01AJC2Y.10.88.H11.1.454.CMB.2.raw
  modified_base (359)..(359): a, c, t, g, unknown or other
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgcccgtggggcctcagtgaagatctcctgcgaggtcttctggttactacctttaacacctatggcatctccgtgggtcgcgacacggcccctggacaaggtcttggaggtgggggtgggggtggtcgagcgtcttaccgaagttggactanactaaattngcacagaaacgttccgaaggacagagtcaccagtcgaaccacgaagaacacgactacccgaacgaacgacaacacgaccctaacaagtacgggtaacctagggggaacgggtacggccgtaggagacgtacgtacggaacgaccgtaaccgggtacccgttaattactttaacgtcggaccggtacggaaacgggtaaacggtaaacgggttaaaaggttcggttaacggggttaacggggttacgggtttaacccggggggactaacggacggttaacggaaccggtaaccccggggg

SEQ ID NO: 440338 - DNA, 644 bp, Homo sapiens
  misc_feature: GZ8MTXP01B24LL.10.88.H11.1.454.CMB.2.raw
  modified_base (538)..(538): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttactacctttaacacctagtggcatctcgtggtgcgacgacggcccctggacgaaggcttggaggtgggggtggggtggtcgagcgtacttaaccgagttcggactacgaactaaaatttatgacaacaggtaaaacgtttcccgaagggaactaaggacgttaccaaccgagtacgaaacccaacagaaccaacactaccgacgaacgacacacgacctacagtaggaacgtagggacggagccgtaggacgagtcgtaggaccgtacgaccggtccgtaacgttntttaacgtcgacggacggaaggaacggtaaacggttaaaggttcggaacgggttgggttaacgggttaaccgggggactacgagttaaccggaacgtaacccgggg

SEQ ID NO: 440339 - DNA, 691 bp, Homo sapiens
  misc_feature: GZ8MTXP01E28SW.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggtcttctggttactacctttaacacctagtggctatctccgtgggtgcgacgacggcccctaggacaaggtcttggaggtgggggtgggggtgggtcaggcgtcttaaccgaaggtttcggacttaacgaactaaaattgtagacaacgaggtaaaacgttaccgaaggaaccaggacgtacaaccgatacgaacccacaacgaacaacactaccgacgacgacacacgacctaacaagtacggaacgtaggggacggacgaccgtaggacgacgttccgacggaaccgaaccgtaccggtacccgttaagtttacgtttaaccgtcgggacggacggaaagggaaacgggtaaacggttaaaagggttcggttacggggttaacggggtaccgggtttaacccggggggaacaccggttacgtaaccggttaaccggtaacccggggg

SEQ ID NO: 440340 - DNA, 590 bp, Homo sapiens
  misc_feature: GZ8MTXP01ACYMI.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttaccacctttaacacctagtggcatctccgtgggtgcgacacggcccctggacaaggcttggaggtggggtgggtggtcagcgcttacgagttgctacactaattngcacagaaagttccaaggacagagtcacatcgaacccacagacacactaccacgacgacacacgacctacagtacggaactaggggaggacgcctagagacgtcgtacgaccgaccgaccggtaccgttattagtttctcggacggacgaaggaacggtaaacggttaaacggttcggttacgggttgggtacggttaacccggggggacaccgagtcggaaccgtaacccggg

SEQ ID NO: 440341 - DNA, 714 bp, Homo sapiens
  misc_feature: GZ8MTXP01AR1PP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcgagtgaagatcctcctgcgaggtcttcgtggttacctacctttaacacctatcggctatcgtccgtgggtcacgacgacggccccgtaggacaaaggtcgtttggagggttgggggtaggggtcgggtacaggtccgtacgtttaaccgaaggtttcggactaacaactaaagtttatagaccaactaaggtaaaacgttcccgaaggacaaagtacgtaccaacctagtacgaaaccccaacaacgaaccaacgactaccaacgacgacaacctacgacccttaacgacgtacgggaaacgtgggggaacggacgtaccgtagacgacgttacgacgaaccgacgtaaccggtacccgttattcgttaacgtcggacggtacggaaggtaaacggtaaacggttaaaacggttcggttaacgggttaagggtaaccggggttaaccgggggaacacggttacgtaaccggttaaccggtaacccgggg

SEQ ID NO: 440342 - DNA, 623 bp, Homo sapiens
  misc_feature: GZ8MTXP01BGOBL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacaccttaacacctatggcatctccgtgggtgcgacgacggcccctggacaaggcttggaggtggggtgggggtggtcagcgcttaccgagttgctacactaaattatgcacgagaaacgttccaaggacagacgtcaccatcgaccacagacacactaccacgacgacaacacgacctaacagtacggaaaccgtagggggaacggggacgacccgtaggaacgaacgtcgtacggaaccggaaccgtaccgggtacccgttaagttaacgtttcgtcggccgacggaggaaacggtaacggttaaaaggttggttacggtaagggttacgggttccgggggacacgacgtaacggaaccgtaacccgggg

SEQ ID NO: 440343 - DNA, 577 bp, Homo sapiens
  misc_feature: GZ8MTXP01E4GZ1.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttcgtggttacacctttaacacctatggcatctcctgggtgcgacacggcccctggacaaggacttgaggtgggggtgggtgggtcagcgcttaccgagttggctacacaaattatgacacagaaaacgttccaaggacagagtacaccatacgaccacagacacataccacgacgacacacgacctacaagtaggaactaggggaggacgccgtagagagtcgtagacgacgacggaccgtattacttctggcgacgaaggaagtaaacggttaaaggttcggacggtaagggtacggttaaccggggggaacacgagtcgaacgtaacccggg

SEQ ID NO: 440344 - DNA, 702 bp, Homo sapiens
  misc_feature: GZ8MTXP01CBSUQ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggtcttctggttaaccacctttaacacctagtggcatcctccgtgggtgcgacgacggcccctggacaaggtacttggagggttgggggtgggggttgggtcaggtccgtacttaaccgaaggttcggacttaacgaactaaaagtttactggactaacgaaggtaaacgtttacccgaaggacaggacgtaccaacgatcgaacccacacgaacacactaccacgagaccacacgacctacagtaggaaccgtggggaacgggacgacccgtaggaacgtaagtccgtacggaaccgtaccgtaccgggtaccgttacttaacgtttcgtcggttacggaccgggaaaggtaaacgggtaaacggttaaaaacgggttcgggttaaccgggttaacggggttaaccgggtttaaccggggggaactaccggttaaggtaaccggaaccggtaaccccggggg

SEQ ID NO: 440345 - DNA, 763 bp, Homo sapiens
  misc_feature: GZ8MTXP01BZCBD.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttcgtggttacctacctttaacaccttagtggcatcgtccgtgggtcgcgacgacggcccccgtaggacaaaggtcgttggagggtgggggtgggggtggtcgaggtccgtactttaaccgaaggtttcggaccttaacgaaactaaaagtttacgtggaccaacgtaaggtaaaacggtttacccgaaggggaacaacgggtaacggttacccaaccgtaagtaccggaaacccaacgaacgaaccaacactacccgaaccggaacgaccaaccgacgacctaacgaacgtaacgggaacgtacgggggaacgggacgtaccgtaggaacgtacgtaccgtacggaaacccggaaccgtaaccggggtacccgtttaagttacgtttccgtcggttaccggacggaaaggaaacggtaaacgggttaaaacggttacgggttacggggttaacggggttaacggggttaacccggggggaactaacggttacgtaaccgggaaccggtaacccggggg

SEQ ID NO: 440346 - DNA, 558 bp, Homo sapiens
  misc_feature: GZ8MTXP01C0XVT.10.88.H11.1.454.CMB.2.raw
  modified_base (370)..(370): a, c, t, g, unknown or other
  modified_base (539)..(539): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttctggttacacctttaacacctatggcatctccgtgggtgcgacacggccccctggacaaggcttggaggtgggggtgggggtgggtcaggcgtcttaccgaaggttggactacactaaattangcaacagaaaacgttccaagggacagagtcaccatcgacccacagacacatccacgagacacagcctacataggaactggggaggagcctagagatcgtgaacgacgtacggccgtattattctgcgcgagagaacgttaaagttggacgtgggtaggttccggggganacgatcgaacgtaaccggg

SEQ ID NO: 440347 - DNA, 540 bp, Homo sapiens
  misc_feature: GZ8MTXP01D8W05.10.88.H11.1.454.CMB.2.raw
  modified_base (480)..(480): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctgggggctgaggtgaagagccctgggggcctcagtgaagatctcctgcgaggtcttctggttacacctttaaacacctatggcatctcctggggtgcgacaggccccctggacaaaggcttgagtggggtggggtggtcagcgcttaccaagttggctacacaaattatgcaacagaaaagttccaagggacagagtcaccatgaccacagacacatccacgagcacagacacatagaacgtaggaggaagccgtagagatctgacgacacggccgtatattaactgcgngagagtaacgttaaaaggttgacggtggtagttcgggggacacgatcgaacgtaaccggg

SEQ ID NO: 440348 - DNA, 714 bp, Homo sapiens
  misc_feature: GZ8MTXP01AJJPF.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttctggttacacctttaacacctatggctatcctccgtgggtcgcgacgacggccccctaggaacgaaggtcttggagggttgggggtgggggtgggtcaggccgtactttaaccgaggtttcggactaacaactaaattatgacacgaagtaaacgttcccgaaggacaggacgtccaaccatacgaacccacacgaacaacactacccgaacgacgaccaaccacggacccttaacgagtacggaaccgtaggggaacgggaaccgtccgtaggaacgtaacgtccgtacggaaccggaaccgtaaccggggtaccgttaacgtttaacgtttccggtacggaccggacggaaacggtaaacgggtaaaccggttaaaagggttcgggttaacggggtttaagggttaaccggggttaacccggggggaacctaacggttacgttaacggaacccggtaacccggggg

SEQ ID NO: 440349 - DNA, 652 bp, Homo sapiens
  misc_feature: GZ8MTXP01D1NCI.10.88.H11.1.454.CMB.2.raw
  modified_base (377)..(377): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacctacctttaacacctagtggctatctccgtgggtcgcgacgacggccccctaggacaaggacttggaggtgggggtgggggtggtcagccgtacttaccgaagtttggactacaacgtaaattngacacgagtaaacgttccgaaggacaagacgtcaccatgaacccacagacacactaccacgagacaacacgacctaacgagtaaggaacgtaggggaagggacgtacccgtaggaagtacgtacgtacggaaaccgaacgtaccgggtacccgttaattacgtttaactcggacggacggaaacggtaaaggtaaacggttaaaagggttcggttaacggttaacggggtaacgggttaaccggggggacacgttagtcggaaccgtaacccggg

SEQ ID NO: 440350 - DNA, 733 bp, Homo sapiens
  misc_feature: GZ8MTXP01AFWZS.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcattgaagatctcctgcgaggtctttctggttacacctttaacacctagtggcatctccgtgggtcgcgacgacggcccctaggaacaagggtacttggacggttgggggtgggggtggtcaggtcgtacttaaccgaagtttcggactaacaactaaaatttctaggacaacgaggtaaaacgtttacccgaaggggaacaagggacgtaccaaccagtacgaaacccacaacgacaacaactaccaacgacgacaacacgaccctaacgaagtacgggaaacgttacgggggaacggacggtacccgtaggaacgtacgtaccgtacggaaaccggaacccgtaaccgggtacccgttaacgttacgttttaaccggcggttaccgggacggttaaacgggaaacggtaaaccgggttaaaagggttacgggttaaccgggttaacggggttacggggttaacccgggggggaacaaccggttacggttaacggaaccggtaacccggggg

SEQ ID NO: 440351 - DNA, 695 bp, Homo sapiens
  misc_feature: GZ8MTXP01A41XA.10.88.H11.1.454.CMB.2.raw
  modified_base (225)..(225): a, c, t, g, unknown or other
  modified_base (297)..(297): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctgaggtgaagacgccgtggggcctnagtgaagatctcctgcgaggtcttcgtggttacctaacctttaacaccctagtggctatcctccgtgggtcncgacgacggcccctaggacgaaggtcttggaggtggggtgggggtggtcgaggtcgtacttaccgaaggttcggactaacgaactaaatttagtgacaacgaggtaaaacgttcccgaagggacaaggacgtaccaccgtatcgaaccacagaaccactacaccgacgacgacacacgacctaacagtacggaacgtggggaacggacgtccgtaggaacgtacgtacgtacggaaccgaccggtaccgggtaccgttaagttaacgtttcggtacggaccggacggaacgggtaacggtaaaccgggttaaaggttcgggttaacgggttaaggggttacccggggttaaccggggggaacctacggaccggttaacggaacccggtaacccggggg

SEQ ID NO: 440352 - DNA, 742 bp, Homo sapiens
  misc_feature: GZ8MTXP01CPHO7.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctggaggtgaagacgcccgtgggggcctcgagtgaagatctcctgcgaggtcttctggttacctacctttaacacctagtggctatctccgtgggtcgacgacgacggcccctaggaacaaaggtcttggaggtgggggtggggtcgggtcagtcgtacttaccgtaaggtttcggactaacaactaaaattagtacggacaacgtaaggtaaaacgtttacccgaagggtaacaaacgggtaacgtaccaaacccgtaagtaccggaaacccaacgaacgaacaacactacccgaacgacgaccaacacgacctaacagtacggaaaccgtagggggaacggtacggacctaggaacgtactacgtacggaaacccggaccgtaaccgggtacccgttaattacgtttaacgtacgggaccggtacggaaacggtaaacggtaaacggttaaaacgggttcgggttaacgggttaacggggttaaccggggtttaacccggggggaactacggttacgttaaccggaacccggtaacccggggg

SEQ ID NO: 440353 - DNA, 678 bp, Homo sapiens
  misc_feature: GZ8MTXP01A48H5.10.88.H11.1.454.CMB.2.raw
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctccgtgcgaggtcttcgtggttaccacctttaacacctagtggctatctccgtgggtcgcgacgacggccccgtaggaacgaaggtcttggaggtgggggtgggggtggtcaggcgtcttaccgaagttgactacaactaaattntgacaacgagtaaaacgttccgaaggacaaggacgtaccaaccgatcgaaacccacaacgaacaacactaccgaacgacgaccaacacgacctaacgaagtacggaacgtacggggaaggacgtaccgtaggacgtagtacgtaggaaccgtaccgtaccggtaccgttacgttactttcgtcggcggacggaacgggtaaaggtaaacggttaaaagggttcgggttaacgggttaacggggtacggttaacccggggggaacacggttacgtaacggttaaccggtaacccgggg

SEQ ID NO: 440354 - DNA, 690 bp, Homo sapiens
  misc_feature: GZ8MTXP01BP4F8.10.88.H11.1.454.CMB.2.raw
  modified_base (375)..(375): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcattgaagatctcctgcgaggcttctggttacacctttaacacctatggcatctccgtgggtgcgacacggccccctggaacaaggacttggaggttgggggtgggggtgggtcaggcgtacttaaccgaaggtttcggactacaactaaaatttntagacaacgtaagaaaacgttcccaagggaccaaggtacgtacaaccagtacgaaacccacgaacgaaccaacaactacccaacgacgacaacacgacctaacagtaggaacgtgggggaacggacggtcctaggagtatcgtacggaaccgaaccgaccgggtaccgttaattcgtttaaccgtcggaccggtacggaaggaaacggtaaaacgggttaaaaggttcgggttaaccgggttaagggggttaccgggtttaacccggggggggaaccaacggttacggttaacggaacccggttaaccccggggg

SEQ ID NO: 440355 - DNA, 705 bp, Homo sapiens
  misc_feature: GZ8MTXP01AF438.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctcctgcgaggtcttcgtggttactacctttaacaccttatggctatctccgtgggtcgcgacacggcccctaggaacgaaggtacttggagggtgggggtggggtgggtcacggcgtaccgttaacgaagtttcggacttacgaactaaatttagtgaccaacgaaggtaaaacggtttacccgaagggtaccaaagggtacgtaccaaccgagtaccgaacccaacgaacgaaccacactacccgacgacgaccaacacgacccttaacagtacgggtaacgtaggggacggacggtccgaggaacgtacgttcgacggaccggaaccgaccgggtaccgttaacttagtttcgtcggacggacggaaggaaacgggtaaacggttaaaggttcggttacggggttaacgggttaacggggttcccggggggaactacggttacggtaacgaacccggtaacccggggg

SEQ ID NO: 440356 - DNA, 731 bp, Homo sapiens
  misc_feature: GZ8MTXP01DI1F7.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagaggccctgggggcctcagtgaagatctcctgcgaggtcttctggttacctacctttaacacctatggcatctccgtgggtgcgacacggcccctaggacgaaaggcgttggaggtgggggtgggggtgggtcaggcgtacttaccgaagtttcggactaacaacgtaaattgtagcaacaaggtaaaacgttccgaagggacagtagtccaaccagtacgaaaccacaacgaccaacactaccaacggacgacaacgacgacccttaacgacgtaaggaaccgttagggggaacgggacgtacccgtagggaacgtacgtacgtacggaaccggaccgtaaccgggtacccgttaagtttacgttttaaccgttcgggaccgggaccggaaagggtaaacgggtaaaccgggttaaaaaagggtttcggggttaaacggggtttaacgggggtttaaaccggggtttaacccggggggaaacgtaacccggaggtttaaccgggaacccggttaaccccggggg

SEQ ID NO: 440357 - DNA, 651 bp, Homo sapiens
  misc_feature: GZ8MTXP01CR9LS.10.88.H11.1.454.CMB.2.raw
  modified_base (238)..(238): a, c, t, g, unknown or other
  modified_base (268)..(268): a, c, t, g, unknown or other
  modified_base (319)..(319): a, c, t, g, unknown or other
  modified_base (338)..(338): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagactcctcgngcgacgtcttcgtacgttacctacttaacnctagtcgctatctcggtggtcgcgacgccgcccgtagaacgaggtcgtggnggtgggggtggggtgacgngcgttactacgtaggtcgactacaaactaattgcgacaacgtaagtaaaccgttacgaacggaacgaaggtaccgtacaaccgtagtccgaaaccacgaacgaaccacgtaccaccgaagacgaccaacgacgtacccgtaggacgaacgtggaacggggctcgtagaacgtcttcgacggaccgacggacgtacttaagttctttcggcgcgaggacgaacggtaaacggtaaggttcggttacgggttcgggttaaccgggggtacccggggaatacggtacgttacgaacccgttcggggtaacccgggg

SEQ ID NO: 440358 - DNA, 712 bp, Homo sapiens
  misc_feature: GZ8MTXP01AKHG8.10.88.H11.1.454.CMB.2.raw
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctgagtgaagatctcctgcgaggtcttcgtggttacctacctttaacacctagtggctatcctccgtgggtcgccgacacggcccccgtaggacaaggtcgttggaggtgggggtgggggtggtcgaggcgtacttaccgaaggttcggactaacgaacgtaaatttngacaacgaggtaaaacgttccaagggaccaggtacgtccaacctatacgaacccaacacgaacaacactacccgaacgacgacaacacgaccctaacgacgtacgggaaaccgtagggggaacggtacggaccgtagacgtacgtcgtacggaaaccggacgtaccggggtaccttaacgttacgtttccgtacgggcggaacggaaagggtaaacggtaaacgggttaaaacgggttcgggttaaccggggttaaggggttaaccggggttaacccggggggaaactacgggttaacgttaaccgggaacccgtaaccccggggg

SEQ ID NO: 440359 - DNA, 656 bp, Homo sapiens
  misc_feature: GZ8MTXP01ASEDK.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggcttctggttactaccttaacacctatggcatctccgtggggtcgcggaccgacggcccccgtagggaaccaagggtactttggagggttggggggttgggggtggggttacgaggtccgtacgtttaaccgaaggtttcggacttaacaactaaagttatagacaacgaggtaaaacgttcccgaagggtacaaggagtaccacagtacgaccacagacacactaccacgacgcacacgacctacgagtaggaactggggaggacgcctagacgtagtcgtagaccgacgtaccggtaccgttatactttcgtcggacggacgaaggaaacggtaacggttaaaacggttcggacggttaagggtacgggttaacccgggggaacacggttacgtcggaaccgtaacccgggg

SEQ ID NO: 440360 - DNA, 708 bp, Homo sapiens
  misc_feature: GZ8MTXP01CIASM.10.88.H11.1.454.CMB.2.raw
  modified_base (267)..(267): a, c, t, g, unknown or other
  modified_base (382)..(382): a, c, t, g, unknown or other
  modified_base (597)..(597): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggtcttctggttacacctttaacncctagtgcatctcgtgggtgcgacacggcccctagacgaaggacttggaggtgggggtgggggtggtcaggtccgtacttaaccgaaggtttcggactaacgaactaaatttagngtacaacgtaggtaaaacgttcccgaagggtaaacaagggtaacgtaccaaacccgtataccggaaacccaacgaacgaaacaacactacccgaacgacgacaaccgacgacctaacaacgttagggaaaccgttagggggaacgggacggtacccgtaggacgtaatccgtacggaaaccgaaccggtaccggttaccgttaattagttttcgnggccggtaaggaacgaaaggtaaacggttaaaaaggttcgggttaaacgggttgggttaacggggttaacccgggggaacgtacgacgttaacggaaccggtaacccgggg

SEQ ID NO: 440361 - DNA, 656 bp, Homo sapiens
  misc_feature: GZ8MTXP01BX8D0.10.88.H11.1.454.CMB.2.raw
  modified_base (382)..(382): a, c, t, g, unknown or other
  modified_base (545)..(545): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacctacctttaacacctagtggcatcctccgtgggtcgccgacgacggccccctagggacaaaggtcgttggaggtgggggtgggggtggtcgaggcgtcttaccgaaggtttggactacgaactaaatttngacagtagaaacgttcccgaaggtacagacgtacaccatacgaacccacaagacacactccacgacgcaacgcgacctaacagtacggaaccgtggggaacggtacgccgtagagtacgtcgtacggaccgaacgtaccgggtaccgttagttacgtttccgnggaccggaacggaaggtaacggtaaacggttaaaaggttcggttaacgggttaacgggttacgggttaacccgggggacacgttacgtaacggttaaccgtaacccggggg

SEQ ID NO: 440362 - DNA, 665 bp, Homo sapiens
  misc_feature: GZ8MTXP01D4NI3.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggcttctggttacacctttaacacctatggcatctccgtgggtcgcgacgacggcccctggacaaaggcttggaggtggggtgggggtggtcaggcgtacttaccgaaggttcggactaacgaactaaaatttgtgacaacgaaggtaaaacgttcccgaagggaaccaagggacgttaccaacccgtagtacgaacccaacgaacgaaccaacactacccaacggaacgaccaacacgacctaacgagtacggaactggggaacggacgaccgtagaagatcgtacgaaccgacgaccggtacccgttattacgttttcgtggaccggacggaaaggaacggtaaacggttaaaaggttcggttaacgggttgggttacggttcccggggggaacacgttagtaacggaacccgtaacccgggg

SEQ ID NO: 440363 - DNA, 648 bp, Homo sapiens
  misc_feature: GZ8MTXP01BHO7Z.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacctacctttaacacctatggcatctcgtgggtgcgacacggcccctggaacaagggcttaggaggtgggggtgggggtgggtcgaggccgtacgtttaccgaaaggtttcggacttaaacaaacgtaaaagtttatggacaacgaaggtaaaacgttcccgaagggaacaaggagtaccaccgaatcgaacccaacgagaaccaacactaccacgagaccacacgacctacagtacggaacgtaggggaaggacgaccgtaggacgatcgtacggaaccggaccgtaccgggtacccgtagttagtttcgtgcggacgaaggaagaacggttaaaaggttcggttaacgggtgggtacggttccgggggaactacggacgtcggaacgtaacccgggg

SEQ ID NO: 440364 - DNA, 649 bp, Homo sapiens
  misc_feature: GZ8MTXP01DZKMQ.10.88.H11.1.454.CMB.2.raw
  modified_base (626)..(626): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggtcttctggttaacctacctttaacacctatcggctatctccgtgggtcgcgaccacggcccccgtaggacaaaggacgttggagggttgggggtgggggtggtcaggtccgtacttaaccgaaaggtttcggactaacaactaaaattatagacaacaagtaaaacgttcccaagggaacaagacgtaccaacctatacgaacccacaacgacaacactaccgaacgacgacaacacgacctacgaagtaggaactaggggaacggagaccgtagagtatcgtaggaaccgacgaccggtaccgttaattactttcgtggaccgacggaaagtaaggtaaacgttaaaaggttggacggttggtaacgggttccgggggaanacgagtaacgaaccgtaaccggg

SEQ ID NO: 440365 - DNA, 748 bp, Homo sapiens
  misc_feature: GZ8MTXP01ERVE7.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttactacctttaacacctatggcatctcgtgggtgcgacacggcccctaggacaaaggtcttggaggtgggggtggggtggtcaggtccgtctttaaccgaagtttcggactaacgaactaaaatttagtcgacaacgtaaggtaaaacggttacccgaagggtaacaaggtacgttaccaaccgtagtacgaaacccaacgaacgaaccaacactaccgaacgaacgacaacgacgacctaacgagtacgggaacgtaggggaacggtacggtaccgtaggaacgtacgtccgttacggaaccgaaccgtaacccgggtacccgtttaacgttacgttttccggttcgggaccggtaccgggttaaacgggtaaacgggtaaaaccgggttaaaaagggttcgggttaaaccggggtttaaggggtttaaccggggtttaacccggggggggaactaacccggttaacggtaaccgggttaaccgggtaaccccggggg

SEQ ID NO: 440366 - DNA, 703 bp, Homo sapiens
  misc_feature: GZ8MTXP01BKKOY.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctctgcgaggtcttcgtggttactaccttaacacctatggcatccgtcgtgggtgacgacgacggcccctaggacaaggtcgttggagggtgggggtgggggtggtcgaggtcgtacttaacgaggttcgactaacaactaaattgagaccagtaacggtaaaacgttccgaagggtacaacggtaacgtaccaaccgtaagtaccgaaacccgaacgaacgaaccaacaactacccgaaacggacgaccaaccgacgtacctaaccagtacggaaacgtacggggaacggacgtaccgaggacgtacgtcgtacggaaccgaaccggtaccggtacgttaacgttcgtttaacgtcggacgggtacgaaggtaaacggtaaacggttaaaaggttcgggttacgggttaacggggtacgggttaaccgggggaacacggttacgtaacggttaacccggtaacccggg

SEQ ID NO: 440367 - DNA, 576 bp, Homo sapiens
  misc_feature: GZ8MTXP01DRFGB.10.88.H11.1.454.CMB.2.raw
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggggcctcgagtgaagatctcctgcgaggtcttctggttactacctttaacacctatggcatctccgtgggtgcgacacggcccctggacaaggcttgaggtgggggtggggtgggtcaggcgtacttaccgaaggtttggactacaactaaattntgacacagaaacgttccaaggacaggagtcaaccatcgaccacagacacactaccaacgacgcacacgacctacagtacggaactggggaacggagtccgtagagactcgtacgaacgacgtacggtcgtattattcgtgcgacgagaagtaagttaaaggttgacggtggtacggtccgggggacacgagtcgaacgtaaccggg

SEQ ID NO: 440368 - DNA, 641 bp, Homo sapiens
  misc_feature: GZ8MTXP01BT2CK.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagcgccgtggggcctcagtgaagatctctgcgaggtcttctggttacctacctttaacacctatcggctatctccgtgggtcgcgacacggccccgtaggacaaggtctggaggtgggggtggggtggtcaggcgacttaccgagttggactacactaaattntgacaacgagtaaacgttcccgaaggactagacgtcaccatcgaccacagacacactccagacgcaacacgacctacagtaagaaccgtaggggaacgggacgtaccgtagaacgtacgtcgtacggaaccgacggtaaccggtaccgttacgttacgtttcgacgcggacggaagtaaacggtaaacgttaaaacgggttcggttaacgggttaacgggtacggggttaaccgggggactaacggttacgtaaccggaaccgtaacccgggg

SEQ ID NO: 440369 - DNA, 685 bp, Homo sapiens
  misc_feature: GZ8MTXP01CSJ8J.10.88.H11.1.454.CMB.2.raw
  modified_base (251)..(251): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctggaggtgaagagcccgtgggggcctcgagtgaagatctcctgcgaggtcttntggttacacctttaacacctatggcatctccgtgggtcgacgacgacggcccctaggacaaggtcttggagggtggggtgggggtcggtcgaggcgtacttaaccgaggtttcggactaacaactaaaattagtacgaccaacgtaagtaaaacgtttacccgaagggaacaagggtaacgtaccaaccctaagtacgaaacccaacgaacgaccaaacactacccgaacggaagaccaaccaacggaccttaacgaacgttacgggaaaccgttaggggaaacgggacgtacccgttaggaacggtaactcgtacggaaacgaccgtaaccggtccgttaatttagttaacgtcggacgacggttaagaaggtaaacgttaaagttcggacggtaagggtacggttcggggacacgagtcgaacgtaaccggg

SEQ ID NO: 440370 - DNA, 846 bp, Homo sapiens
  misc_feature: GZ8MTXP01DCPBI.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggtcttctggttacacctttaacacctatggcatctccgtgggtcgcgacacggcccctggacaaaggcttggaggtggggtgggggtgggtcaggccgtacgttaccgaaaggtttcggactaacaaccgtaaaatttagtacgtacgaaacgtaaggtaaaaaaccggttttccccgaagggggaaaccaaggggtaacgttacccaaaccccgtaattacgggaaaccccaaccgaaacggaaacccaaacccaaacgtaccccgaaaacccgggaaacggaacccgaaaccaaccggtaacccttaaaccgaacgttaaacggggtaaacccgttagggggaaacggggtaacttacccgttaggaacgtaacgtaccggttacggaaacccggaaccgtaaccgggtaccgttaacgtttaacgttttaaccgtacgggttccggaacggttaaacgggtaaacgggtaaaccggttaaaaaaaggggtttccggggttaaaccggggtttaacgggggttaaaccggggttttaaccccgggggggggaaactaaacccgggttaggtttaaccgggaacccgggttaaacccccggggg

SEQ ID NO: 440371 - DNA, 604 bp, Homo sapiens
  misc_feature: GZ8MTXP01A099D.10.88.H11.1.454.CMB.2.raw
  modified_base (195)..(195): a, c, t, g, unknown or other
  modified_base (298)..(298): a, c, t, g, unknown or other
  modified_base (307)..(307): a, c, t, g, unknown or other
  modified_base (435)..(435): a, c, t, g, unknown or other
  modified_base (560)..(560): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgtctttttcnccgaggggacagagtcaccctctcctgtagggccagttatggtgttggcgtcctaatttaaactggtaaccaacagaaacgtggccaggctcccaggctcctnatctacgancatcccacgacggccacgtggccgtcccagccctagggttcgatgggcagggtcgggtcctgggacagtacttcaactctcacatcagcagccgtggactcagaagattattgacttaagttttattnttgctagactaggcggtaagcgtagggttcggtaccctttcggtaaccgtttccgggggaacccgggaactaaaggtaggaaactacgaaacgtaacgttggtacgggctcggaccttaccgttnttccgtgttcttaacctacgttccttccccgaacttaacgtccg

SEQ ID NO: 440372 - DNA, 761 bp, Homo sapiens
  misc_feature: GZ8MTXP01C1RF0.10.88.H11.1.454.CMB.2.raw
tcagcatagtagtgcacgaccggtgctcgatttagcgacagcgagaacacacaaagggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccgtggggcctcgagtgaagatctcctgcgaggcttctggttacacctttaacacctatggctatctccgtgggtgcgacgacggcccctggaaccaaaggacttggaggtgggggtgggggtgggtcgaggcgtcttaaccgaaggtttcggacttaacaactaaaacttatgacaacgaagtaaaacgtttcccgaagggacaaggtaacgtaccaacctaagtcgaaacccacaacgaccaacactaccaacgacgaccaaacgacgacctaacaacgtagggaaaccgtaggggaacgggtaacggacccgttacggaaggtaacgtaccgttaacggaaacccgggtaaccgaaaccggggtacccgttaaatttaacgttttccgttacgggttacccggtaagggttaaaccggtaaagggtaaaaccgggtttaaaaaagggttcggggttaaaccggggtttaacgggggttaaaccggggtttaaccccggggggggtaaacaacccggttaaacggttaacgggaaccccgtaaaccccggggg

SEQ ID NO: 440373 - DNA, 628 bp, Homo sapiens
  misc_feature: GZ8MTXP01CINV9.10.88.H11.1.454.CMB.2.raw
  modified_base (277)..(277): a, c, t, g, unknown or other
  modified_base (387)..(387): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagagcccgtggggcctcagtgaagatctcctgcgaggtcttctggttaccacctttaacacctatggcanctccgtgggtcgcgacgacggccccgtaggacgaaaggtcgttggaggtgggggtgggggtggtcgaggcgtcttaccgaaggttggactacgaactaaattatgacaanacgtaaacgttccaaggacagacgtcaaccatacgaaccacacgaacacatacccaagacgacaacacgacctacaagtacggaaccgtgggggaaggacgtccgtagaaggtacttaccgaggaaccggaacgaccggggtaccgttattctttcgtcgcggacgaggtaaacgaaggttaaaacggttggttaacggtgggtacggttcgggggaacacgagtcggaacgtaacccggg

SEQ ID NO: 440374 - DNA, 669 bp, Homo sapiens
  misc_feature: GZ8MTXP01ARKAX.10.88.H11.1.454.CMB.2.raw
  modified_base (371)..(371): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactaccctttaacacctatggcatctccgtgggtcgcgacacggcccctggaccaaggtcgttggaggttgggggtgggggtggtcaggcgtacttaccgagttgactaacactaaattngacacgaagtaaacgttcccgaagggaccaaggtacgtaccaaccatacgaacccacagacacactccgacgacgcacacgacctacagtacggaacgtacggggaaggacgtaccgtagaagtacgtcgtacgaaccggaccgtaccgggtacccgttaagttacgtttcgtcggcggtaccggaaggtaacggtaaaccgggttaaaagggttcggttaccggggttaacgggttacggggttaacccggggggtaaccacggttacgtaaccgggttaacccggtaaccccgggg

SEQ ID NO: 440375 - DNA, 741 bp, Homo sapiens
  misc_feature: GZ8MTXP01AHEWT.10.88.H11.1.454.CMB.2.raw
  modified_base (234)..(234): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcgagtgaagntcctctgcgaggtcttcgtggttaacctacctttaacaccttagtggctatccgtcgtgggtcgcgacgacggccccgtaggaacgaaggtacgtttggagggttgggggtgggggtggtcgaggtccgtacgttaaccgaaggtttcggaacctacaaacgttaaattcgtacggactaacgaaggtaaaccgttacccggaagggacaagggtacgaccgaacctacgaccgaacccaacaacgaaccaactactaccgaacgaacgacaacgacgacctaacgaacgtacggtaaccgtagggggaacgggtacgtaccgtaggaacgtacgtccgtaacggaacccggtaaccgtaccggtaccgtttaacgttacgttttccgacgggttccggaaaggaaacggtaaacgggtaaaacggttaaacgggttacggttacggggttaacgggttaccgggttaacccgggggaactacggagtccggaacggtaacccgggg

SEQ ID NO: 440376 - DNA, 628 bp, Homo sapiens
  misc_feature: GZ8MTXP01BF1ME.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctcctgggtgcgacaggcccctggacaaggcttgaggtggggtggggtggtcaggcgcttaccgagttggctacactaaattatgcaacagaaacgttccaaggacagacgtcaccatacgaccacagacacatccaacgacgcaacacgacctaacaacgtaggaaaccgtacggggaagggaacgtaccgtaggaagtacgtacgtacggaaccgaacgtaccgggtacccgttaagttacgtttcgtcggcggacggaaggtaaacggtaaacggttaaaaggttcggaacgggttcgggtaacgggttaacccggggggaacacgttacgttaacggaaccgtaacccgggg

SEQ ID NO: 440377 - DNA, 756 bp, Homo sapiens
  misc_feature: GZ8MTXP01DWFPV.10.88.H11.1.454.CMB.2.raw
  modified_base (421)..(421): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtggaagacgcccgtggggcctcgagtgaagatcctcctgcgaggtcttcgtaggttaacctaacctttaacacctagtggctatcctccgtggggtcgaccggaccgaccgggcccccgtagggaaccgaaagggtcgtttgggaggggttgggggtggggggtcgggtcaggccggtactttaaccgaaggttcggactaaacaactaaaagttntcgacaacgaagtaaaacgttaccgaagggacaagtacgtccaacctagtacgaacccaacacgaacacactacccaagacgaccaacgacgacctaacgacgtacgggaaaccgtagggggaacggtacggtaccctaggaacgtaacgtaccgtaacggaaccgtaccgtaaccggggttacccttaagtttaacgtttcggtacggacggtaacggttaaaggtaaacgggtaaacggttaaaaagggttcggggttaacgggttgggggttaaacggggttaacccggggggaactacggttacggtaacggttaacccggtaacccgggg

SEQ ID NO: 440378 - DNA, 804 bp, Homo sapiens
  misc_feature: GZ8MTXP01BJZ3F.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttactacctttaacacctagtggcatctccgtgggtcgcgacgacggcccccgtagggaacctaaagggacgtttggaggttcgggggtgggggtgggtcgaggtcccggtactttaaccgaaaggtttcggaccttaaacaaccgtaaaattttacgtacggtacaaaccgtaagggtaaaaaccgtttccccgaagggggtaaccaaagggtacgttacccaaccccgtaagtaccgggaaaccccaacgaacgaacctaacaactacccgaacggaacgaccaaccacggtacccttaacaagtacgggaaaccgttacgggggaaggtaacggaccgttaggaacgtactaccgtagggaacccgaaccgtaacccgggtacccgttaagtttaacgttttccgtacgggaccggtaccggaaagggaaacgggtaaaccgggttaaaaagggttcgggttaaccgggggttaaggggttaaaccgggggtttaacccgggggggaaaccaaccggttacgttaaccgggaaacccggtaaccccggggg

SEQ ID NO: 440379 - DNA, 758 bp, Homo sapiens
  misc_feature: GZ8MTXP01CYO7G.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctgagtgaagatctcctgcgaggtcttctggttacacctttaacacctatggcatctccgtgggtcgcgacacggcccctaggaacaaggtacttggaggtgggggtgggggtggtcaggcgtactaaccgtaaggttcgactaacgaactaaaatttagtgactaacgaaggtaaaacgttacccgaaggggaacaaggaacgttaccaaaccagtacgaaacccaacaacgaaccacaactacccgaacgaacgaccaacacgaccctaacgaacgttacgggaaacctagggggaacgggtaacgacccgttaggaaacgtacgtaccgtacggaaacccggtaaccgaaccggggttacccttaaagtttacgttttccgtacggaccgggtacggaaacgggtaaacggtaaaaccgggtttaaaaagggttcggggttaaaccggggtttaagggggttaaccgggggtttaacccgggggggaaacctaacggttaacggtttccgggaaacccggttaaccccgggggg

SEQ ID NO: 440380 - DNA, 596 bp, Homo sapiens
  misc_feature: GZ8MTXP01BXO40.10.88.H11.1.454.CMB.2.raw
  modified_base (518)..(518): a, c, t, g, unknown or other
  modified_base (576)..(576): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagccctggggcctcgagtgaagatctcctgcgaggtcttctggttactacctttaacacctatggcatctccgtgggtcgcgacgaggccccctaggacaaaggcttgaggtgggggtgggggtgggtcaggcgcttaaccgaaggttggctaacactaaattatgacacagtaaaacgttccaagggacagacgtcacctagtacgacccaacagacacatacccacgaacgacaacacgacctaacagtaggaactaggggaagggagtcctagagacgtcgtaggaaccgacgacggtccgtaacttnttcgtgcggcgagaacggtaacgttaaaagttcggacggtgggtaggttccggggganacgagtcgaacgtaaccggg

SEQ ID NO: 440381 - DNA, 596 bp, Homo sapiens
  misc_feature: GZ8MTXP01D86MR.10.88.H11.1.454.CMB.2.raw
  modified_base (196)..(196): a, c, t, g, unknown or other
  modified_base (262)..(262): a, c, t, g, unknown or other
  modified_base (272)..(272): a, c, t, g, unknown or other
  modified_base (403)..(403): a, c, t, g, unknown or other
  modified_base (411)..(411): a, c, t, g, unknown or other
  modified_base (551)..(551): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgttctttttcnccgaggggacagagtccaccctctcctgtagggccagttatggtgttggcgtccttaatttaaacnggtaaccaanagaaacgtggccaggctcccaggctcctcatctacgagcatccacgaggccacgtcggcctcccagccctaggttcgatggcaggtgggtcctggggacagacttcaactctcacatcagcagcctggacnctagaagntagttgacttagttttatagttgtacagtacagtcggggtagcgtagggttcggtcctttacgaccgtttccggggacccggggtaactaaaggttcgaaaacgtcgaaaacgtcgttggtacggctacgccttaacttnttcgttcgttacttcctacgttcccttacccgtccttaacttccg

SEQ ID NO: 440382 - DNA, 744 bp, Homo sapiens
  misc_feature: GZ8MTXP01BH7L8.10.88.H11.1.454.CMB.2.raw
  modified_base (239)..(239): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtcgtggggctggaggtagaagacgcccgtggggcctgagtgaagatctccgngcgaggtcttcgtggttacctacctttaacacctagtggctatctcgtgggtcgccgacgcggccccgtaggaaccgaaggtacgttggtagggttgggggtgggggtggtcgaggccgtacgttaaccgaggttcggactaactaacgtaaatttagagactaacaaggtaaaacgttacgaagggaacaaggtacgtaccaactacgtacgaacccaacgacgaaccaacactaccgacgaacgaccaacgacgaccctaaacgtacgtaacggtaacgtagggggaacggacggtaccgtaagaacgtacgtcgacggaaaccggaacgtacccgggtacgttaacgtttacgtttcgtacgggaccgggaacggaaacgggtaaacggtaaacgggttaaaacggggttcgggttaaccggggtttaacgggggttaacggggttaacccggggggaaactaccgggttaagttaacccgggaaccgggtaaccccggggg

SEQ ID NO: 440383 - DNA, 648 bp, Homo sapiens
  misc_feature: GZ8MTXP01EVY5Y.10.88.H11.1.454.CMB.2.raw
  modified_base (372)..(372): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatctcctgcgaggtcttcgtggttactacctttaacacctagtggctatcctccgtgggtcgcgacgacggcccctggaacaaggtcttggaggtggggtggggtggtcagcgtacttacgagttgactacgactaaattntgacacagtaaacgttccaaggacagacgtcaaccatcgaaacccacagaacacacaccgaacgaacgaccaacgacgaccttaacgagttaaggaaccgtagggggaaggacgtccgtagacgtatccgtacggaaccgaccgtaccggtacccgttaagttctttcgtggaccggacggttaaaggtaaacggtaaacggttaaaagggttcggttaacgggttgggtacgggttcccgggggaacacgttagtaacggaaccgtaacccgggg

SEQ ID NO: 440384 - DNA, 785 bp, Homo sapiens
  misc_feature: GZ8MTXP01AOR1Y.10.88.H11.1.454.CMB.2.raw
  modified_base (378)..(378): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggggcctcgagtgaagatctcctgcgaggcttctggttacaccttacacctatggcatctcgtgggtgcgacgacggcccctggacaaggacttggaggtgggggtgggggtggtcaggccgtactttaaccgaaggtttcggactaaacaacgtaaaatttgngaccaacgaacggtaaaacgtttcccgaagggaaccaagggtacgtaccaacccagtacggaaacccacaacgaacaacgactacccgaacgacgaccaacgaccgacccttaacgaagtacgggtaaacccgtagggggaacgggaacggtacccgtaggtaaacggtacgttaccggtaacggaaacccggtaaccgtaaacccggggttacccgtttaagtttaccgttttaaccggttacgggttacccgggaacgggttaaacgggaaacgggttaaaccggggttaaaaacgggttacggggttaaccggggtttaacgggggttaacccgggggtttaacccggggggggaaactaacccgggttaacggttaaccgggaacccggttaaccccgggggg

SEQ ID NO: 440385 - DNA, 605 bp, Homo sapiens
  misc_feature: GZ8MTXP01D1MNI.10.88.H11.1.454.CMB.2.raw
  modified_base (329)..(329): a, c, t, g, unknown or other
  modified_base (357)..(357): a, c, t, g, unknown or other
  modified_base (362)..(362): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggcctcagtgaagatctcctgcgaggtcttctggttacacctttaacacctatggcatctccgtgggtgcgacacggcccctggacaaggcttgaggtggggtggggtggtcngcgtcttacagttgactacactaaattntgcanagaaacgttaccaaggacagagtcaccatcgaccacagacacactaccacgacgacacacgacctaacgataggaactaggggaacgggagaccgtaggagactcgtacgaaaccgaccgtaaccggtacccgttattactttcgtcggcggacggaaggaacggtaaacggttaaaaggttcggttaacgggttaaggttaacgggttccgggggacacgacgtcggaaccgtaacccgggg

SEQ ID NO: 440386 - DNA, 661 bp, Homo sapiens
  misc_feature: GZ8MTXP01EYU8V.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggctatctccgtgggtcgcgacgacggcccctggaacaaggtacttggagggtggggtgggggtgggtcaggccgtactttaccgaaaggtttcggactaacgaactaaaagttatgacaacgaggtaaaacgttccaaggacagacgtcaactatcgaccacagacacataccagacgacacgacgacctacagtacggaacgtaggggaacggacgccgtaggacgtactcgtacggaaccgaccgtaccggtaccgtttaacttacgtttccgtacggaccggtacggaaacggtaaacggtaaacggttaaaagggttcggttacgggttaaggggttacgggttaaccggggggaacacggttacgttaacggaaccggtaacccgggg

SEQ ID NO: 440387 - DNA, 708 bp, Homo sapiens
  misc_feature: GZ8MTXP01D7KZC.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctccgtgcgaggtcttcgtggttacctaacctttaacacctagtggctactcgtccgtgggtcgaccgacgacggcccccgtaggaacgaaggtacgttggagggttgggggtgggggtggtcaggccgtacttaaccgtaaggtttcggacttaacgaactaaattgacgacaacgaggtaaaacgttcccgaagggacagacgtaccaaccatacgaacccacaacgaacaacactacccgaacgaacgaccaacgacgacctaacgaagtacggaaaccgtaggggaacgggtacgtacccgtaggaacgtaacgttccgtacggaaaccgtaccggtaaccgggtacccgtttaatttacgtttaacgcggaccgtacggaaaggaaacggtaaacggttaaaaggttcggttacgggttaagggtacgggttaaccgggggactacgagtaacggaacgtaacccgggg

SEQ ID NO: 440388 - DNA, 597 bp, Homo sapiens
  misc_feature: GZ8MTXP01BD1B0.10.88.H11.1.454.CMB.2.raw
  modified_base (323)..(323): a, c, t, g, unknown or other
  modified_base (345)..(345): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctcctgcgaggtcttcgtggttacctacctttaacacctatggcatctcgtgggtcgcgacgacggcccctggacaaggctgagtgggnggtggcaggcgactacgagtgntacgacaattngcacgacgaaagttccgaagggaccagggactacaccaatacgaccagaacgacgacacaccgacgacgacacacgacgacagtacgacgacgggacggacgacgtagagacgtcgtacgacgacgtaccgtacgttacgttacgttcgtcgcggacgaacgtaacggtaacggttaacggttacggttacggtaacgggtacgggtaaccgggtacgtacgacgtaacgaaccgtaacgg

SEQ ID NO: 440389 - DNA, 693 bp, Homo sapiens
  misc_feature: GZ8MTXP01EPEIK.10.88.H11.1.454.CMB.2.raw
  modified_base (301)..(301): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctcctgcgaggtctttcgtggttacctaacctttaacaccttagtcggctatccgtccgtgggtcncgacgacggccccctaggaacaaggtcgttggagggttgggggtggggtggtcaggtccgtacgtttaccgaaggttcggactaacgaactaaagttgtgacgaacaaggtaaaacgttcccgaaggaacagacgtacaaccagtacgaacccacagaaccacgactaccgaacgacgacaacacgacctaacgagtacggaacgtagggggaacggacgtccgtaggacgtacgtacgacggaaccgacgtaccgggtacgttacgttcgtttcgcggacggtacggaaggtaacggtaaacggttaaacggttcgggttaacggttaacggggttacgggttaacccgggggaactacggttacggttaaccggaaccggtaacccgggg

SEQ ID NO: 440390 - DNA, 707 bp, Homo sapiens
  misc_feature: GZ8MTXP01CDAYV.10.88.H11.1.454.CMB.2.raw
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgcccgtggggcctcagtgaagatctccgtgcgaggtcttctggttacctacctttaacacctagtggcatccgtccgtgggtcgaccgacgacggcccccgtaggacaaagggtacttggagggttgggggtgggggtggtcaggtccgtactttaaccgaaggttcggactaacgaactaaattngacaacgaaggtaaacgttcccgaaggacaaggacgtaccaaccagtacgaaacccaacgacgaacaacactacccgaacgaacgaccaaacgacgacccttaacgaagtacggaaaccgtaggggaacgggacggtacccgtaggaacgtacgtacgtacggaaccgaccgtaccggtaccgttaagttacgtttcgtcggaccggacggaaaggtaaacggtaaacggttaaaagggttcggttaacgggttaacgggttaacgggttaaccgggggacacggttacgtaacggaaccgtaacccgggg

SEQ ID NO: 440391 - DNA, 687 bp, Homo sapiens
  misc_feature: GZ8MTXP01DO4SJ.10.88.H11.1.454.CMB.2.raw
  modified_base (268)..(268): a, c, t, g, unknown or other
  modified_base (274)..(274): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggccccagtgaagatctctgcgagtcttctgttacacctttaacactangcatcnccgtggtcgcgacgacggcccctaggaacaaggtacttgggaggttgggggtgggggtggtcaggtccgtacgtttaaccgaaggtttcggactaacgaactaaacttatacgtacaacgtaagtaaacgttaacccgaagggaacgaacgaacgtaccaacctaagtacgaacccaacgaacgaacacaacgtaccaacgacgacaacacgtacctaacagtacggaacgtggaacggggcgtaccgtagaacggactccgtagaaccggaccgtaccgggtaccgttaattacgtttcgcggacggttacggaaggaaacggtaaacggtaaaagttcgggttaccggttaggggttaacggttacccgggggaactaccggtagttacggaaccgccgggtaaccggggg

SEQ ID NO: 440392 - DNA, 751 bp, Homo sapiens
  misc_feature: GZ8MTXP01CT3GO.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggtcttctaggttacacctttaacacctatcggctatctccgtgggtcgccgacgacggcccctaggacgaaggtacgttggaggtgggggtgggggtggtacgacggtccgtactaacgtaggttcgtaactacgtaactaaattacgacgacgaacgtaacggtaaacgttaccgaacggtacgaacggtacgtactagtactaacgtaccgaacccaacgtacgaacctacgaaacctcccggaaacggacgaccaaccgaccgtacctaacgtaggttaaccggaacggtacgggaacgggaccgtacccggaaggtacgtacgtaccggtaacgaacccggtaaccgtacccgggttaccgttagttaacgtttcggcggaccgggttaacggaaacgggtaaccggttaaaacggttaaacgggttcgggttaacggggttacgggtttaaccgggggtacccgggggtaacttaacggtaaccggttaaccggtaaccccggg

SEQ ID NO: 440393 - DNA, 735 bp, Homo sapiens
  misc_feature: GZ8MTXP01E3E5V.10.88.H11.1.454.CMB.2.raw
  modified_base (299)..(299): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgccgtggggcctcagtgaagatctcctgcgaggtcttcgtaggttaacctacctttaacacctagtcggctatccgtccgtgggtcnccacgacggcccctaggaacaaggtacgttggagggtgggggtgggggtggtcacggcgtacttaaccgaaggtttcggactaacgaaactaaaatttagtacgacaactaacggtaaaacgttacccgaagggacaagggtacgtaccaacctagtaccgaaacccaacgaacgaaccaacactaccgaacgacgacaacgacgaccaacagtacgaacgtaggggaaggacgccgtaggaacgtacgtaccgtacggaaccggaaccggtacccgggtaccgttaactttacgttttcgacggacggtaacggaaacggtaaacgggtaaaacggttaaaagggttacgggttaacggggttaacgggggttaccggggttaacccggggggtaacaacggttacggtaaccgggaacccggtaaccccggggg

SEQ ID NO: 440394 - DNA, 730 bp, Homo sapiens
  misc_feature: GZ8MTXP01DP20W.10.88.H11.1.454.CMB.2.raw
  modified_base (294)..(294): a, c, t, g, unknown or other
  modified_base (299)..(299): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacggcccgtgggggcctcgagtgaagatctcctgcgaggtctttcgtggttactacctttaacacctatggcatctccgtgggtncgacncggcccctaggaacaaagggcttggaggtgggggtgggggtggtcaggtcgtacttaaccgaaggtttcggacttaacgaactaaaattgtagacaacgaaggtaaaaacgttcccaagggacaagggtactccaaccaatcgaacccaacacgaacacactaccgaacgacgacaaccacgaccctaacaacgtagggaaacgtagggggaacgggaacgtaccgtaggaagtctacgtacggaaacccggtaaccggaacccgggtaccggtttaacttaacgtttccgtacgggaccggtaaccggaaaggaaaacggtaaaaccggttaaaaagggttcggttaaacggggtttaacggggttaaccggggtttaacccggggggaaccttaacggaacgttaaccgggaaccggtaaccccggggg

SEQ ID NO: 440395 - DNA, 636 bp, Homo sapiens
  misc_feature: GZ8MTXP01B0UMS.10.88.H11.1.454.CMB.2.raw
  modified_base (525)..(525): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttctggttactacctttaacacctatggcatctcgtgggtgcgacgacggcccctaggacaaggtcttggaggtgggggtgggggtggtcaggcgtcttaaccgaaggtttggctaacaactaaattagtgacaacgaagtaaacgttccaaggacagagtccacatcgaccacagacacactaccacgacgcaacacgacctacagtacgaacgtggggaacggtagtccgtagaacgtacgtcgtacggaaccggacctaccggggtaccgttagttntttcgcggcgacgggaacgtaaacggtaacggttaaaacggttcggttacgggttaaggggttacgggttccgggggactacggttacgtaacggaacccggtaaccgggg

SEQ ID NO: 440396 - DNA, 756 bp, Homo sapiens
  misc_feature: GZ8MTXP01CXRBZ.10.88.H11.1.454.CMB.2.raw
  modified_base (305)..(305): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctggaggtgaagacgcccgtggggcctcagtgaagatctcgtgcgaggtcttcgtaggttacctaacctttaacaccttatcggcatcctccgtgggtcgacggaacncgggcccccgtaggaaccaaagggtctttggagggttcgggggtgggggtggtcaggtcgtacttaccgaagtttcggactaacaacgtaaaatttagtgaccaacgaaggtaaaacgtttacccgaagggaccaaaggtacgtccaaccatcgaaccaacacgaacaacactaccgaacgaagaccaacaacgaccctaacaacgtaacgggtaaaccgtagggggaacgggaacggtacccgtaagggaacgtaacgtaccgtacggtaaaccggaccggtaaccgggtacccgttagttaacgtttaaccgtacgggaccggtacggaaggtaaacggtaaacggttaaaaaagggttcggaaacggggtttaacggggttaaaccgggtttaaccgggggggtaaaccgaaccggttaacgttaaccggaacccggtaaccccgggg

SEQ ID NO: 440397 - DNA, 700 bp, Homo sapiens
  misc_feature: GZ8MTXP01CZC52.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtgggggcctcgagtgaagatctcctgcgaggtcttctggttacacctttaacacctatggcatctccgtgggtgcgacacggccccctaggacaaggtcttggaggtgggggtgggggtgggtcaggcgtacgttacgaaggtttggactacactaaaattatagcaacaggaaaacgtttccaagggtacagtacgtcaccatacgaccacagaacacactaccaacgagaccaacgacgacccttaacaagtacggaaccgtagggggaacgggacggtacccgtaggaacgacgtccgtacggaaccgaaccgtacccgggtaccgttaacgttaacgtttcgttcgacgggtaccggaaagggtaaacggtaaacgggttaaaaagggttcggttaacggggttaacgggggttaacgggttaacccggggggggtaacctaaccgggaagtttaaccgggaaccggttaaccccggggg

SEQ ID NO: 440398 - DNA, 739 bp, Homo sapiens
  misc_feature: GZ8MTXP01COL71.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggagggtgaagaggcccgtggggcctcgagtgaagatcctccgtgcgaggtcttcgtaggttaacctacctttaacacctagtggctatctcgtgggtcgcgacgacggcccctaggacaaggtcgttggagggttgggggtagggggtcggtcgaggtcgtacgttaaccgtaaggttcggactaacgaactaaaactttagagaccaacgaaggtaaaacgttcccgaagggaccagggtaacgtaccgaaccagtacgaaacccaacgaacgaaccaacgaactacccgaacgacgacacacgacctaacaacgtaggaacgtgggggaaacggacgtaccgtagaacgtacgtaccgtacggaaccggaaccgtaaccgggttaccgttaacgtttacgtttccggtacggcggtaaccggaaggtaaacgggtaaacggttaaaagggttcgggttaaaccgggttaacggggttaacggggttaaccggggggtaactaacggttacggtaacggaaccggtaaccccggggg

SEQ ID NO: 440399 - DNA, 684 bp, Homo sapiens
  misc_feature: GZ8MTXP01ELHKQ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctgggggctggaggtgaagagcccgtggggcctgagtgaagatctcctgcgaggtcttctaggttacctacctttaacacctatcggctatcctccgtaggggtcgaccgaccgacgggcccccgtagggaaccgaaagggtctttggagggttggggggttggggggtcgggtacgaggccggtactttaaccgaaggtttcggaccttaaacacgtaaaattagtcggacaacgaaggtaaaacgttcccaagggacaaggacgtccaacatacgaacccaacgacgaaccacactaccgacgaacgcaacagaccctaacgagttaacgggaacgtagggggaacggacgtaccgtaggagacgtcgtacgaccgaccgtacggtccgttacttagttctcgcggacgaaggtaagtaacggttaaaggttcggacggttaagggtacgggtaaccgggggacacgttacgtaacggaaccgtaaccgggg

SEQ ID NO: 440400 - DNA, 686 bp, Homo sapiens
  misc_feature: GZ8MTXP01DBM5V.10.88.H11.1.454.CMB.2.raw
  modified_base (385)..(385): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtggggcctcgagtgaagatctcctgcgaggtcttcgtaggttacctacctttaacacctatcggctatctccgtgggtcgcgacgacggcccctaggacgaaaggtcttggaggtgggggtgggggtggtcaggcgtctaaccgtaaggttcggactacaactaaattntcgacaacgaagtaaacgttccaagggtacaaggacgtacaaccatcgaacccaacagaacacactaccacgaagcaacacgacctaacagtacggaacgtggggaacggacgtaccgtaggaagtacgtacgtacggaaaccgaccgtaaccgggtacccgttaatttacgttttcgtcggaccggtaccggaaggtaaacggtaaacggttaaaaagggttcggttaaacgggttaacggggttaacgggttaaccggggggaactacggttaacgtaaccggaaccgtaacccggggg

SEQ ID NO: 440401 - DNA, 664 bp, Homo sapiens
  misc_feature: GZ8MTXP01D211A.10.88.H11.1.454.CMB.2.raw
  modified_base (371)..(371): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttaccacctttaacacctatggcatctccgtgggtcgacgacacggccccctaggacaaaggcttggaggtgggggtgggggtggtcaggcgtcttaccgaaggtttggctacgactaaattntgacacagaaacgttccgaagggtacagacgtcacctatcgaacccacgacgacaacactacccacgaacgacacacgaccttaacagttacggaaaccttgggggaacggacgtccgtagacgatcgtaggaaccgaccgtaccggtacccgttaattacgtttaacgttcggaccggaccggttaaaggtaaacggtaaacggttaaaaagggttcggttaacggggttaacggggttaacgggttcccggggggaactacgttacgttaacggaaccgtaaccccggggg

SEQ ID NO: 440402 - DNA, 668 bp, Homo sapiens
  misc_feature: GZ8MTXP01C6BCP.10.88.H11.1.454.CMB.2.raw
  modified_base (566)..(566): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtgggggcctcgagtgaagatctccgtgcgaggtcttctggttaccaacctttaacacctatggcatcctccgtgggtcgcgacgacggtcccccagggacaaagggtcttggagggtgggggtgggggtggtcaggccgtcttaccgaagttcggactaacaactaaagttctaggacaacgaggtaaaccgttccaagggacaggacgtaccaacctagtcgaaaccaccgaagaccaacactccaacgacgcaacgtacgaccttaacaagttaggaaacgtcggggaaggcgtaccgtaggagtacgtactcggaaaccgaccgtacggtaccgttaagttctttcgnggcggtacgaaagaacgggtaaaccgttaaaaggttcggttacggtcggggttaacgggttaaccgggggacacgttacggttccgaacggtaaccccgggg

SEQ ID NO: 440403 - DNA, 600 bp, Homo sapiens
  misc_feature: GZ8MTXP01DC68H.10.88.H11.1.454.CMB.2.raw
  modified_base (364)..(364): a, c, t, g, unknown or other
  modified_base (369)..(369): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttacacctttaacacctatggcatctccgtgggtgcgacgcggcccctggacaaggacttgaggtgggggtggggtggtcaggcgtactaccgaagttggactacacaaattangacanagaaacgttccaaggacagagtacaccatcgaaccacagacacatcccaagacgacacacgacctaacagtacggaactggggaaggacgccgtagagatcgtacgacgaacgtccggtaccggtacttatttcgcgttacggacgaggtaaacgtaaacggttaaaaggttggttaacggttgggttaccgggttccggggggaacacgaagtcgaaccgtaacccgggg

SEQ ID NO: 440404 - DNA, 727 bp, Homo sapiens
  misc_feature: GZ8MTXP01AL8A0.10.88.H11.1.454.CMB.2.raw
  modified_base (246)..(246): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggtcttntggttacacctttaacacctatggcatctcctgggtgcgacacggcccctggacaaggcttggaggtgggggtgggggtgggtcgaggcgtacgtttaccgaaggtttcggactaacgaactaaaatttagtggacaaccaaggtaaaacgtttcccgaagggtaccaagacggtccaaccagtacgaacccacagaaccaacactaccacgacgaccaacacgacctaacatacgggaactaggggaacgggacgtcccgtagaacgtactacgtacggaaccggaaccgtaccgggtaccgttaacgtttacgtttaaccgtcggttaccggaaccgggttaagtaaaccgggtaaaacggttaaaaacgggttcgggttaaaccggggtttaacgggggttaaccggggttttaacccgggggggggaaaccgtaaccggttaacggttaaccgggaaacccggttaaccccgggggg

SEQ ID NO: 440405 - DNA, 698 bp, Homo sapiens
  misc_feature: GZ8MTXP01CI7OP.10.88.H11.1.454.CMB.2.raw
  modified_base (375)..(375): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttactacctttaacacctatggcatctccgtgggtcgcgacgacggccccctggaacaagggacttggaggtgggggtggggtgggtcaggcgtcttaccgaaggttggactacgaactaaaatttntgacacgagaaacgttccaagggacaagagtcacatcgaaccacagacacactaccacgacgcaacacgacctaacaacgtacgggtaaaccgtagggggaacgggtaacggcccgtaggaacgtacgtccgtacggaaccggaaccgtaaccggggtacccgttaaagtttaacgtttccgtcgggaccgggtaccgggaaagggtaaacgggtaaacgggttaaaaacgggttacgggttaacgggttaacgggggttaacgggtttaacccgggggggaactaaccggttaacgttaacgggaacccgtaaccccggggg

SEQ ID NO: 440406 - DNA, 638 bp, Homo sapiens
  misc_feature: GZ8MTXP01BM591.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttaccacctttaacacctatggcatctccgtgggtcgacgacacggccccctaggaaccaagggtacttggaggtgggggtgggggtggggtccaggtccggtactttaaccgaaggtttcgggaccttaacgacctaaaatttagtgaccaacgtaggtaaaacgttcccgaagggaccagggtacgtccaccatcgacccacacgacacactaccacgacgacacacgcctacgagtaggaactggggaggacgtcctagacgatcgtagacgacgtacggtaccgtattacgttctgacggacgaagaacggtaacgttaaaggttcgttacggtaagggtacggttaaccgggggacacggttagtcggaaccgtaacccgggg

SEQ ID NO: 440407 - DNA, 663 bp, Homo sapiens
  misc_feature: GZ8MTXP01BH4N6.10.88.H11.1.454.CMB.2.raw
  modified_base (266)..(266): a, c, t, g, unknown or other
  modified_base (269)..(270): a, c, t, g, unknown or other
  modified_base (304)..(304): a, c, t, g, unknown or other
  modified_base (352)..(352): a, c, t, g, unknown or other
  modified_base (357)..(357): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctgagtgaagatctctgcgagtcttctgttacacttacactangcnnctcgtggtgcgacgcggcccgtgacgaggctggnggtggggtgggtggtcagcgtcttacgagttcgactacaactaaattngacanaggtaaacgttccgaaggacaaggacgtccaactagtacgaaccacagacacactaccacgacgacacgacgacctaacgagtaggaacgtaggggacggacgaccgtaggaacgtacgtaccgtacggaaaccggaccgtaccgggtaccgttagtttacgtttcgtacggaccgggtacggttaaagggtaaacggtaaacgggttaaaagggttcgggttaaccggggttaacggggttaaccgggggttaacccggggggaacctaacggttacggtaaccgggaacccggtaacccggggg

SEQ ID NO: 440408 - DNA, 721 bp, Homo sapiens
  misc_feature: GZ8MTXP01EAJZ3.10.88.H11.1.454.CMB.2.raw
  modified_base (696)..(696): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctcctgcgaggtcttctggttactaccttaacacctatggcatcgtccgtgggtcgacgtacgacggtccccgtggaacaaaggtacgttggaggggttgggggtcgggggttgggtcgtaggccgtctttaaccgaaggtttcggacttaacaacgttaaaattagtcgacgtaactaaggtaaacgttacccgaagggaacaaggtacgtaccaaaccgtagtacgaaacccaacgacgaaccaacagtacccaacggaacgaccaacacgtacctaacgaacgtaagggtaaaccgacgggggaagggacgtacccgtagaaggtaactacgttacggaaaccggaccgtaacccggtacccggttaaatttacgtttaacgtacggttacggacggttaaacggaaagttaaacgggttaaaggttcggttacggtcgggtaacggtccgggggtanacgagtaaccgaacggtaacccggg

SEQ ID NO: 440409 - DNA, 601 bp, Homo sapiens
  misc_feature: GZ8MTXP01BW930.10.88.H11.1.454.CMB.2.raw
  modified_base (266)..(266): a, c, t, g, unknown or other
  modified_base (478)..(478): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggtacacctttaacacctanggcatctccgtgggtgcgacaggcccctgaacaaggcttggagtggggtggggtgggtcaggcgctttaccgaagtttcggactacgactaaacttatgacacgagaaaagttcccaagggaccaagacgtacaccgatcgacccacacgacacatccacgacgcaacagacctacatagggaacaggggacggagccgagacggattccgngaacccgacgaaccgggtcctaattacttccgtagcccggacgaggaacggtaagttaaaacggttggacggttggggtaacggtttccggggggaacacgagtaacggaacgtaacccgggg

SEQ ID NO: 440410 - DNA, 647 bp, Homo sapiens
  misc_feature: GZ8MTXP01DYGYR.10.88.H11.1.454.CMB.2.raw
  modified_base (372)..(372): a, c, t, g, unknown or other
  modified_base (546)..(546): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggtcttctggttacctacctttaacacctatggcatctccgtgggtgcgacacggcccctggacaaggtcttggaggtgggggtgggggtgggtcaggcgtacttaccgaggtttcggactacaactaaattntggtacacaaggtaaaagttcgaagggacaagggaacgtaccaaccagtacgaacccaacgaagaccaacactacccgaacgaacgcaaccgacgacctaacatacggaacctaggggaacggtacggccgtaggaagactcgtacggaaccgacgtaccggtacggttacttnttcgtgcggacgaaggtaaaggtaacgttaaaaggttcggttacggttaagggttacgggtaaccgggggtaacacgttagtaacggaaccgtaaccgggg

SEQ ID NO: 440411 - DNA, 697 bp, Homo sapiens
  misc_feature: GZ8MTXP01BS32D.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctcctgggtgcgacgacggccccctggacaaggtcttggaggtggggtggggtggtcaggcgcttaccgaagttggactacgaactaaaatttagtgacaacaggtaaaacgtttcccgaagggaccaaggacgtccaaccgtatcgaacccaacagacaacgataccacgacgcaacacgacctaacatagggaaacctagggggaacgggacgtacccgttaggaacgtacgtccgtaggaaaccggaaccgtaccgggtacccgtaagtttacgtttaaccgtcggacggtaccggaaaggtaaacgggtaaaccgggttaaaaagggttcgggttaaaccggggttaaggggttaaaccggggtttcccggggggggaaacacggttacggttaaccgggaaccgttaaaccccggggg

SEQ ID NO: 440412 - DNA, 664 bp, Homo sapiens
  misc_feature: GZ8MTXP01A68CH.10.88.H11.1.454.CMB.2.raw
  modified_base (369)..(369): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcctggggcctcagtgaagatctcctgcgaggtcttctggttacctacctttaacacctatggctatcctccgtgggtcgcgacgacggcccctaggacaaaggtcttggaggtggggtggggtggtcagcgtacttacgaagttgactacgactaaattngacacagaaacgttccaaggtacaggacgtccaacctagtacgaccaacgacgaccaacactaccacgacgacacgacgacctacaagtacggaacgtaggggaacggaacgtccgtaggaagtacgtacgtacggaaccgaaccgtaccgggtaccgttaacgttacgttcgttacggcggaacgaacggtaaacggtaaaccgggttaaaaggttcgggttaaccgggtttaaggggtacgggttaaccggggggactaacggttacggtaacggttaacccgtaacccgggg

SEQ ID NO: 440413 - DNA, 680 bp, Homo sapiens
  misc_feature: GZ8MTXP01CW5JP.10.88.H11.1.454.CMB.2.raw
  modified_base (442)..(442): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttctggttacacctttaacacctatggcatctcgtgggtgcgacgacggccccctggacgaaggacttggaggtggggtggggtagggtcaggcgtcttaccgagttcggactacactaaattatagcacgaagtaaaacgttcccaaggtacagaacggtcaaccgatacgaaccacagacaacacgtaccaacganaccacacgacctaacgagtaggaaccgtaggggaacggacggtaccgtacggaacggacttccgtaggaacccgaacgtaaccggtacccgttaagttaagtttccgttacggccggtaccggaagggtaaacggtaaaccgggttaaaaaagggttcgggttaaaccgggttaaggggttaccgggttaaccggggggaacctacggaacggttaacggaacccggtaacccggggg

SEQ ID NO: 440414 - DNA, 904 bp, Homo sapiens
  misc_feature: GZ8MTXP01C8PJP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtgaagacgcccgtggggcctgagtgaagatctcctgcgaggtctttcgtaggttaacctaacccttttaaacacccttagtcggcctaacgtccgtccgtgggtcgaccgaccgaccggtcccccgtagggaaccgtaaagggtacgtttggagggggttggggggttggggggttcgggttacgacggtccggttaaccgtttaaccggtaaagggttttcgggaaccttaaacgtaaaaccttaaaaagttttacgtcggaaacctaaacgtaaacggttaaaaacggtttaacccgaaggggaaacctaaacgggtaaccggttaacccaacccgtaagttaccggaaaccccaaacgaaacgaaaccaaaccgaactaccccgaaacgggaaccggaaccctaaccgaaaccggtaaccccttaaaccgaaaggttaacgggaaaccgttagggggaaacggggaccggtaccgtaagggaacgtaacgttccggtaacggaaacccggaacgtaacccggggttaccttaaagtttcggtttaaccgcgggacgggaaccggttaaagggaaacgggtaaaacgggttaaaacggttcggggttaaccggggtttaacgggggtaaacccgggggttaacccggggggaaactaaccgttaacggttccggaaacccgggtaaccccgggggg

SEQ ID NO: 440415 - DNA, 686 bp, Homo sapiens
  misc_feature: GZ8MTXP01ADXVA.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgaggtcttctggttactacctttaacacctatggcatctccgtgggtgcgacgacggcccctggacaaggacttggaggtgggggtgggggtgggtcgaggcgtctttaaccgaaggtttcggactaacgaactaaaatttatgacaacgaaggtaaaacgttcccgaagggacaaggacgtaccaaccatcgaacccacagacacactaccacgacgacacacgacctacagtacggaacgaggggacggacgccgtaggaacgtacgtccgtacggaaccggaaccgtaccgggtacccgttaacttacgttttcgtcggttaccggaccggaaagggtaaacggtaaacgggttaaaagggttcgggttaacgggtttaacggggttacggggttaacccggggggaacctacggacgttaacgggaacccgtaacccggggg

SEQ ID NO: 440416 - DNA, 718 bp, Homo sapiens
  misc_feature: GZ8MTXP01CNKE9.10.88.H11.1.454.CMB.2.raw
  modified_base (403)..(403): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctctgcgaggtcttctggttacctacctttaacacctagtcggacatctccgtgggtcgacgtacgacggccccctagggaactaaagggtctttggagggttcgggggtagggggtgggtacgaggccgtacgttaaccgaaggtttcggactaacactaaaaatttntagacaacaaggtaaaacgttcccgaagggaacaaagggtaaacgttaccaacccgaatacggaaacccaaccgaacgaaccaaacactacccaacggacgacaacgacgacctaacgaacgtacgggaaacgtaggggaacggacgtaccgagaacggtactacgagaaaccggacgaaccggtacccgttaattacgtttaacgtcggacggacggaaggtaaacggtaaacggttaaaaggttcggttaacgggttaacgggtaacgggttaaccggggggaacacggttactaacggaaccgtaaccgggg

SEQ ID NO: 440417 - DNA, 724 bp, Homo sapiens
  misc_feature: GZ8MTXP01D6QJB.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcagtgaagatctcctgcgaggtcttcgtggttacctaacctttaacacctagtggcatcctccgtgggtcgaccgacgacggtcccccgtagggaacgtaaagggtctttggagggttgggggttggggttagggtcaggccgtacttaaccgtaaggtttcggactaacaactaaaattgtagacacgaacggtaaaacgttcccgaagggaacaggaacgtaccaacctatcgaaacccaacaacgaaccaacactacccgaacgaacgaccaacgacgacctaacgagtacggaaaccgtaggggaacgggacgacccgtagaacgacgtcgtacggaaccgaaccgtaccggtaccgttaagttacgtttaacgtcggcggaaccggaaaggtaaacgggtaaacggttaaaagggttcgggttaacggggttaacggggttaaacgggttaacccggggggaacacggttacgtaaccggaaccgtaaccccggggg

SEQ ID NO: 440418 - DNA, 697 bp, Homo sapiens
  misc_feature: GZ8MTXP01D1DIC.10.88.H11.1.454.CMB.2.raw
  modified_base (211)..(211): a, c, t, g, unknown or other
  modified_base (379)..(379): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagngcccgtggggcctcagtgaagatctcctgcgaggtcttctggttacctacctttaacacctatggctactctcgtgggtgcgacgacggcccctggaaccaaggtacttggaggtgggggtgggggtggtcgaggcgtcttaccgaaggttcgactacaactaaattntagacaacaaggtaaacgttaccaagggacaaggtacgtacccaacatacgaacccaacaacgaacctacactacccgaacgaacgacctaacgacgacccttaacgaacgttaagggaaccgtagggggaacgggtacgaccgttaggacgtacgtacgtacggaaccgtaaccggtaccgggtaccgtttaatttaacgttccgtggacggacggaaaggtaaagggtaaacggttaaaaggttcggttacgggttaacggtacggggttaaccgggggaacaaccggaccgtaaccggaaccgggtaacccgggg

SEQ ID NO: 440419 - DNA, 674 bp, Homo sapiens
  misc_feature: GZ8MTXP01A1V2H.10.88.H11.1.454.CMB.2.raw
  modified_base (264)..(264): a, c, t, g, unknown or other
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggcttctggttactacctttaacncctatggctatcctccgtgggtgcgacgacggccccgtaggacgaaaggcttggagggtgggggtgggggtggtcacggtcgtacgttaaccgtaggttcggactaacgactaaaattnacgctaacgaggtaaaacgttcccaaggacaaggacgtaccaccatacgaacccacacgacacgactaccacgacgacaacgacgacctaacacgtacggtaaccgtaggggacggagcctaggaagtacttcgacgaaccgacgtccggtacgttaacgttacgtttcgacggttccggacggaaggtaaacggtaaacggttaaacggttcgggttaaccggggttaagggttaccggggtaacccgggggtaacacggttacgttaacggaaccggtaaccccggggg

SEQ ID NO: 440420 - DNA, 617 bp, Homo sapiens
  misc_feature: GZ8MTXP01A6HSR.10.88.H11.1.454.CMB.2.raw
  modified_base (529)..(529): a, c, t, g, unknown or other
  modified_base (554)..(554): a, c, t, g, unknown or other
  modified_base (558)..(558): a, c, t, g, unknown or other
  modified_base (563)..(563): a, c, t, g, unknown or other
  modified_base (579)..(579): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctgaggtgaagagcccgtgggggcctcgagtgaagatctcctgcgaggtcttctggttaactacctttaacacctatggctatctccgtgggtcgcgacgacggcccctgggaacaacgggtctttggaagggttgggggtggggggtacgggtcgacggtccggtctttaaccggaaaggtttcggaccttaacaacgtaaaatttatcggactaacgaggtaaaacgtttcccgaaggaccaagacggtcaaccgaatcgaaacccaacacgaacaacactaccaacgacgacacacgacctacagtaggaactggggagacgcctgagntcgtgaaccgactacggcgtacttnttcncgcgngagagaacgttaaagngacggtggtacggtcggggacacgatcgaacgaacggg

SEQ ID NO: 440421 - DNA, 664 bp, Homo sapiens
  misc_feature: GZ8MTXP01DIMJN.10.88.H11.1.454.CMB.2.raw
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacggcccgtgggggcctcgagtgaagatctctgcgagtcttctggttactaccttaacacctagtgcatctccgtgggtgcgacgacggcccctaggacaaggtcgttggaggtgggggtgggggtggtcaggtcgtacttaaccgaaggttggacctaacaactaaatttagngacaactaaggtaaacgttaccgaagggaactaaggaacgtccaaccagtacgaaacccgacaacgacaacacaccacgagaccactaacgacctacgagacgaacgtaggggaaggtacgaccgtaggaagtacgtcgtacgaccgacgtaccggtaccgttaagttacgtttcgacgccggaacgaaggtaaacggtaaacggttaaaaggttcggttaacgggttaagggtaacgggttaaccgggggaacacggttacgtcggaaccgtaacccggg

SEQ ID NO: 440422 - DNA, 702 bp, Homo sapiens
  misc_feature: GZ8MTXP01AQT80.10.88.H11.1.454.CMB.2.raw
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgcccgtggggcctcgagtagaagatctcctgcgaggtcttctggttaacctacctttaacacctatggctatctcgtgggtgcgacgacggcccctggacaaggtcttggaggttggggtgggggtggtcaggccgtcgttaaccgtaggttcggactaaacgactaaaattntaggacaacgtaaggtaaacgttcccgaagggtaaccaaggtacgtaccaaccgaatacgaaaccccacgaagaaccaacactacccaacgacgacaaccacgtaccaacgagtacggtaacgacggggaacgggtacgaccgttaaggacgtacgtacgtacggaacccggaaccggtacccgggtaccgttaacgtttaacgtttcgttacggcggtaaccggaaaggaaacggtaaaccggttaaaaggttcgggttaacgggttcggttaccgggttaaccgggggaacctacggacgtcggaaccgtaacccgggg

SEQ ID NO: 440423 - DNA, 714 bp, Homo sapiens
  misc_feature: GZ8MTXP01EIHK8.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagatctcctgcgaggtcttcgtcggttacctacctttaacacctagtcggcagtctccgtgggtcgacgacgcggtcccctaggaacgaaaggtcgttggagggttgggggtagggggtcggtacgaggcgtacttaaccgaggttgactaacacgtaaattgagacacgaacgtaaacgttcccaagggacaagggactaccaccagtacgaaacccacaacgaacaccgactacccgaacggacgacccaacaaccgacctaacgaagttacgaaccgtaggggaacgggaacgtaccgtaggaacgctaccggtaggaaacccggaaccgtaccggggtacctttaaatttcgttaacggtcgccgggtaagaaaggtaaacggttaaacgttaaaacgggttcggttacgggttaaggggttaaaccggggttcccgggggaacaccggttacgtaaccgggaaccgtaaccccggggg

SEQ ID NO: 440424 - DNA, 625 bp, Homo sapiens
  misc_feature: GZ8MTXP01CFIP7.10.88.H11.1.454.CMB.2.raw
  modified_base (195)..(195): a, c, t, g, unknown or other
  modified_base (367)..(367): a, c, t, g, unknown or other
  modified_base (388)..(388): a, c, t, g, unknown or other
  modified_base (407)..(407): a, c, t, g, unknown or other
  modified_base (540)..(540): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccacccttgtctttttcnccgaggggacagagtccaccctctcctgtagggcctagttatggtgttggcgtccttaatttaaactggtaaccaacagaaacgtggccaggctcccgaggctcctcatctacgaagcactcccacgaggccacgtggcctccagccaggttcgagtgcgtaggtgggtccngggacagtaccttcaacttcncacatcagcagcctggacnctaggaacgtattacgttgacttaagttttatagttgacagtcgagtacggtagcgtagggttcgtcctttccgacggtttcccggggaacccgggtaactaaaggtcgggtaaaactacggaaaaaccggtnttaggggtcggacctacgggtaccaaccgttcgttcgttcgtacctttccacgttccccgttccccggaaccttaagttaacccg

SEQ ID NO: 440425 - DNA, 673 bp, Homo sapiens
  misc_feature: GZ8MTXP01DB3GR.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatcctcctgcgaggtcttcgtggttaccaacctttaacacctagtggcatctccgtgggtcgcgacgacggcccccgtggaacaaaggtctttggaggtgggggtgggggtgggtcaggccgtacttaccgaaggttcggactacaactaaaattagtagcaacgaaggtaaacgttaccaagggaacaggaacgtcaaccatcgaacccacaagactaacactccaacgagacaacacgacctaacagtagggaaccgtaggggaacggacgtccgtagagacgtacgtacggaaaccgaaccgtaaccgggtacccgttaattacgttttcgtaggaccggacggaaggaaacggtaacggttaaaaaaggttcggttaaaccgggttgggttaacgggttccgggggaacacggttagtaacggaaccgtaacccgggg

SEQ ID NO: 440426 - DNA, 676 bp, Homo sapiens
  misc_feature: GZ8MTXP01D6ZDG.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagacgcccgtggggcctcgagtgaagatctcctgcgaggtcttctggttaccacctttaacacctatggctatcgtccgtggggtcgacgaccgacggcccccgtaggaacaaagggtcttggagggttgggggtgggggtggtcgaggtccgtacttaaccgaaggttcggactaacgaactaaattatgacaacgaaggtaaaacgttcccgaagggacaggaacgtccaaccatacgacccacacgacacactaccgacgacgacgacacgacctacagtagaacgtaggggacggacgaccgtaggaagtacgtcgtacgaaccgaaccgtaccggtacgttacttaacgttcgtcggaccggacggaaggaacggtaaacggttaaaaggttcgggttacgggttaacggggttacgggttaaccggggggaacacgttacggtaacggaaccggtaacccgggg

SEQ ID NO: 440427 - DNA, 637 bp, Homo sapiens
  misc_feature: GZ8MTXP01CCCMB.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttctggttaccacctttaacacctatggcatctccgtgggtgcgacgacggcccctggacaaggcttggaggtgggggtgggggtggtcaggcgtacttaaccgaaggtttcggactaacgaactaaaacgttgtgacaacaaggtaaaacgtttcccgaagggaccaaggacgtccaacctagtcgaacccacaacgaacacactacccaacgacgaccaacacgaccctaacagtaggaacgtaggggaggacgaccgtaggagagtacgtaggaccgacgtaccggtaccgttattattaacgtgcgacggagaaagtaacggttaaagttcggttacggtaagggttacggttaaccgggggaacacgagtaacgaaccgtaaccgggg

SEQ ID NO: 440428 - DNA, 700 bp, Homo sapiens
  misc_feature: GZ8MTXP01BOCBY.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctccgtgggtgcgacacggcccctggacaaggcttggaggtgggggtgggggtgggtcaggcgtactttaaccgaaaggtttcggactaacgaactaaaaatttagtaggaccaacgtaggtaaaaacggtttcccgaaggggaacaaagggaacgttaccaacccgaatacggaaacccaacgaacgaaccaacaactacccaacgaacgaccaacaacgacccttaacacgtacgggaactaggggaacgggacgaccctaggacggactcgtacggaaaccgaccgaccgggtaccgttaattacgtttcgtcggcggaccggaaggaaacggtaaacggttaaaaggttcggttaacgggttaagggtaacgggttaacccggggggaactacggttacgtaacggaacccgtaacccgggg

SEQ ID NO: 440429 - DNA, 575 bp, Homo sapiens
  misc_feature: GZ8MTXP01EHIJM.10.88.H11.1.454.CMB.2.raw
  modified_base (354)..(354): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctcctgggtgcgacacggcccctaggacaaggcttggaggtggggtgggtggtcagcgcttaccgagttgctacacaaattngacacaagtaaacgttcccaagggacagagtacagtcatgacacagacacataccacgagacacagacctacaataggaacggtaggaggacgccgtagagtacgtacgtacgacgtaaccgaccggtaccgtagtaactttcgttgcgacgaagaagaacggttaaagttaggaacggttaggtaacggtttccgggggacttaccgaagttcggaaccg

SEQ ID NO: 440430 - DNA, 676 bp, Homo sapiens
  misc_feature: GZ8MTXP01BBG98.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacctacctttaacacctatggcatctccgtgggtgcgacacggcccctaggacgaaggtcgttggaggtgggggtgggggtggtcgagcgactttaaccgaaggttcggactaacgaactaaaatttatcgacaacgaagtaaaacgttcccaagggaacagagtccaaccatacgaaccacagaacacactaccaacgacgacacacgacctaacagtacggaacgtggggaacggacgaccgtaggaacgacgttaccgtaggaaaccgaccgtaacccgggtacccgttattaacgtttccgtacggcggaaccggaaaggaaaggtaaaccggttaaaaggggttcggttaacgggttaaggggttaccgggttaaccggggggactaacggttacgtaacggttaaccgtaaccccggggg

SEQ ID NO: 440431 - DNA, 656 bp, Homo sapiens
  misc_feature: GZ8MTXP01D2W3G.10.88.H11.1.454.CMB.2.raw
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagcgcccgtggggcctcgagtgaagatctcgtgcgaggtcttcgtggttacctaccttaacacctatggctatcgtcgtggtcgcgacgacggccccgtaggacaaggtcgttggagggtgggggtgggggtggtcaggtccgtacgttaacgtaaggttcgactaacaactaaattntagacaacgaagtaaacgttccgaagggacaaggacgtaccaacgagtacgaccagacgaacacgactccaagacgacaacacgaccttaagagtacggaactggggaacggacgccgtaggagtacgtcgacggaaccgacgtacggtcttatagttcgcgacgacgaaggtaaacgtaacgggttaaaggttcggttaacgggttaacggggttaaccgggtaacccgggggaacacggttacgtaacgggaacccgtaacccggggg

SEQ ID NO: 440432 - DNA, 761 bp, Homo sapiens
  misc_feature: GZ8MTXP01D12B0.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgccgtggggcctcgagtgaagatctcctgcgaggtcttcgtaggttacctaccttaacacctagtcggctatcctccgtgggtcgcgacgaccggtccccgtaggaacgtaaaggtcgttggaggggttggggggttagggggttgggtacgaggtccgtacgtttaaccgaaggtttcggactaacgaaactaaaatttgtaggactaacgtaaggtaaaacgtttacccgaaggggaaccaaagggtaacgtaccaaccgtaagtacggaaacccaacgaacgaaccacacgtaccgaacgaacgccaacgacgacctaacagtaacggaacgttagggggaacggtacgtaccgttaggaacggtacttcggaacggaaaccggtaccgtaaccggggtaccctttaagtttacggtttaacgtacgggaccggacgggttaaaggtaaaccgggtaaaaggttaaaacgggttgggttaacgggtttaaggggttaacgggttaaccgggggaacacggttagtaaccggaaccggtaacccgggg

SEQ ID NO: 440433 - DNA, 635 bp, Homo sapiens
  misc_feature: GZ8MTXP01BKZ7P.10.88.H11.1.454.CMB.2.raw
  modified_base (344)..(344): a, c, t, g, unknown or other
  modified_base (352)..(352): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgagtgggtggggtggtcagcgcttaccgaagttggctanacaaattntgcacagaaagttccaaggacagacgtcaccatgaccacagacacactaccacgagaccacacgacctacacgtagggaaacctggggaacggagcccgtaggacgaatcgtagaacccgacgtaacccggggcccgttaataacgttttcgtcgggaccggtacccggaaagggaacggtaaacggttaaaaaccggttgggttaaccgggttaagggtaaccgggtttcccgggggggaaaccaacggttaacgtaacgggttaacccgtaaccccggggg

SEQ ID NO: 440434 - DNA, 692 bp, Homo sapiens
  misc_feature: GZ8MTXP01CABO0.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcgagtcgtggggctggaggtgaagacggcccgtggggcctcgagtgaagatcctcgtgcgaggtcttcgttggttaacctacctttaacacctagtcggctactctccgtgggtcgcgacgacggcccctaggacaagggtcgttggagggttgggggtgggggtggtcgagcggtcttaaccgaggtttcggactacaactaaattagtgacaacgaaggtaaacgttacccaagggaaacaaggacgtaccaaccgtatacgaaccacacgaacacactaccgacgacgacacagaccctacaagtacgaacgtaggggaaggtacgccgtaaggacgtacgtccgtacggaccgtaaccgtaccgggtaccgttaatttacgtttcgacggttacgacggttaaggaaacggtaaacggttaaaagggttcggttacgggttaaggggtaccgggtttaaccgggggaactacggttaacgtcggttaaccggtaaccggggg

SEQ ID NO: 440435 - DNA, 663 bp, Homo sapiens
  misc_feature: GZ8MTXP01DSCCO.10.88.H11.1.454.CMB.2.raw
  modified_base (392)..(392): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacctacctttaacacctatggctatctccgtggggtcgcgacgacggcccctggaaccaaagggtacttggaggttgggggtgggggtgggtcgaggccgtcttaaccgaaaggtttcggacctaacgaactaaaatttanggaccaacaagtaaaacgttcccaagggacaggtacgtcaaccatcgaaccacacgacacactaccacgagacaacacgccacataggaactaggggacggagcctagagactcgtggaaccgaccgtaccgggtaccgtaacttaacgtttctcggttccggacgggaaagaaacgggtaaacggttaaaacggttcgggttaaccgggttaaggggttaacgggttcccggggggaactaccgttacgtaacggaaccgtaacccgggg

SEQ ID NO: 440436 - DNA, 661 bp, Homo sapiens
  misc_feature: GZ8MTXP01C7HTV.10.88.H11.1.454.CMB.2.raw
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctgagtgaagatctctgcgaggtcttctggttacctacctttaacacctatggcatcctcgtgggtcaccgacgacggcccctaggacaaaggcttggaggtgggggtgggggtggtcacggcgtctaaccgagttcggactacaactaaattactgcaanaggtaaaacgttccgaaggaacagacgtaccaaccatcgaacccaacaacgacaacactaccaacgacgacaacacgacccaacaagtaggaaccgtaggggaacggacgaccgtagagacgtacgtacggaccgaaccgtaccgggtaccgttaactttacgttcgtcggttacggacggaaggtaaaggaaaccggttaaaagggttacggttaacgggttaagggtacgggttaaccgggggaactacgttacgtaacggaacccgtaacccggggg

SEQ ID NO: 440437 - DNA, 704 bp, Homo sapiens
  misc_feature: GZ8MTXP01CR5WJ.10.88.H11.1.454.CMB.2.raw
tcagcatagtagtgcacgaccggtgctcgatttagcgacagcgagaacacacaaagaggacccaaaaaccacacccctccttgggagaatcccctagatcacagctcctcaccatggactggacctggagcatccttttcttagtggcagcagcaacaggtgcccactcccaggttcagctggtgcagtctggggctgaggtgaagagcccgtggggcctcgagtgaagatctcctgcgaggtcttctggttacacctttaacacctatggcatctccgtgggtcgcgacgacggcccctaggaccaagggtactttggaggtgggggtgggggtggtcagtcgctttacaggttggactaacaacctaaattgtgacacgaaaggtaacgttcccgaagggaccaggacgtacaacctatacgaaccaacgaacgaacaacactacccaacgaacgaccaacgacgacctaacgacgtacgggaaacgttcggaacgggacgtacccgagaacgacgttacgtacggaccggtaaccgaaccggtacccggttaattaacgtttacgttacggtaccggacggaaacggtacgggttaaaaccggttaaaagggttacgggtaaaccggggttacggggttaaaccgggggtttacccggggggggaaccttaaccggtaacggttaaccggtaaaccccggg

SEQ ID NO: 440438 - DNA, 725 bp, Homo sapiens
  misc_feature: GZ8MTXP01BMCFY.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctgagtgaagatcctctgcgaggtcttcgtggttacctacctttaacacctagtggcatctcgtgggtcgcgacgacggcccctaggacaaggcttggaggtgggggtagggggtggtcgaggccgtctttaaccgaaggtttcggactaacgaactaaaagtttagtacgacgaacaagggttaaaaaacgtttccccggaaggggacccaaagggtaacgttacccgaaacccgtaacgtacgggaaacccccaacgaaacggaaccaacgtaactacccgaacgaacggaccaacgacgaccctaacgatacggaacgtaggggaaggacgcctaggaagacgtcgtacggaaccggaccgtaccgggtaccgttaacgtttacgttcgttaggccggtacggaacggaaaggtaaaccgggttaaaaggttcggttacgggttaagggttacgggtaaccggggggtacaacgttacgtaacggaacgtaaccccgggg

SEQ ID NO: 440439 - DNA, 657 bp, Homo sapiens
  misc_feature: GZ8MTXP01B0QHP.10.88.H11.1.454.CMB.2.raw
  modified_base (559)..(559): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctctgcgaggtcttctggttacctacctttaacacctatggctatctcgtgggtgcgacgacggcccctggacaaggtcttggaggtgggggtgggggtgggtacaggtcgtacttaaccgtaaggtttcggactaacaactaaaatttagtgaccaactaaggtaaaacgttccgaagggaaccaagggaacttaccgaccagtacgaacccaacacgaaccaacactacccacgaacgaccaacacgacctacaagtacggaacgtcgggaaggtacgctaggacgtactacgacgaaccgacgtaccggtaccttagttattccgnggttaccgaggaggaaacggtaacgttaaagggttcgttacgggttaagggtacgggttaaccgggggacacgttacggtaacgaaccggtaaccggg

SEQ ID NO: 440440 - DNA, 755 bp, Homo sapiens
  misc_feature: GZ8MTXP01AE2J1.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatctcctgcgaggtcttctggttacctacctttaacacctatggctatctccgtgggtcgcgacgacggcccctggacaaggtcttggaggtggggtggggtggtcaggcgtcttaaccgaggtttcggactacgaactaaattatgacgaacgaaggtaaacgttacccgaaggtaccaaggtacgtacaaccagtacgaacccacaacgacaacactaccacgaacgacaacgacgacctacgaacgtacgggaaacgtacgggggaacggaacggtccgtaaggaacgtaacgtaccgtacgggaaaccggaacccggtaacccgggttacccgtttaaacgtttaacgttttccggtacggttccgggtaaccgggaaagggtaaaccgggtaaaacgggttaaaacgggttacggggttaaccggggtttaacgggggttaacccgggggtttaaccccggggggggaaacctaaccggttaacggttaacccgggttaacccggtaaaccccgggggg

SEQ ID NO: 440441 - DNA, 660 bp, Homo sapiens
  misc_feature: GZ8MTXP01D4VVJ.10.88.H11.1.454.CMB.2.raw
  modified_base (375)..(375): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttactacctttaacacctatggcatctccgtgggtcgcgaccgacggccccctggacaaaggcgtttggaggtgggggtgggggtggtcagccgtacttaccgaagtttggctacaactaaattntagacaacgagtaaaacgttccaaggacaagtacgtcaccatcgaaccacacgaacacactaccaacgagacaacacgacctaacagtagaacgtggggaaacgggacgaccgttaggaacgtacgttacgacggaaaccggaccgtaccgggtacccgttaagttaacgtttaacgtcggcggaaccgggaaaggaaacgggtaaacggttaaaagggttcggttaacgggttaaggggttacgggttaaccggggggacacgagtcggaaccgtaacccgggg

SEQ ID NO: 440442 - DNA, 768 bp, Homo sapiens
  misc_feature: GZ8MTXP01DFBIZ.10.88.H11.1.454.CMB.2.raw
  modified_base (379)..(379): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggagggtagaagacgcccgtggggcctgagtgaagactctccgtgcgaggtcttcgtggttacctacctttaacacctatgcatctcgtgggtgcgacgacggcccctggacaaggtcttggaggtgggggtggggtggtcgagtcgtacgtaacgtagttcggactaacaactaaatttncggacaacgaaggtaaaaccgttaccgaaggggtaacaagggtaacgtacccaaccctaagtcgaaacccaaacaagaaccaacaactacccgaacgaacgacaaccgacgtaccctaacgaacgttaacgggaaacctagggggaagggtaccggaccgtagggaacgtaacgttccgtaacgggaaaccggtaccgtaaccgggttaccgttaaacgtttcgtttaaccggtagggttacccgggtaaacgggaaagggttaaacgggtaaaaccggtttaaaaacggggttcgggttaaacggggttaacgggggttaaaccggggttaacccggggggaaacaaccgttaaacgggtaacccggttaaccccgtaacccgggggg

SEQ ID NO: 440443 - DNA, 721 bp, Homo sapiens
  misc_feature: GZ8MTXP01B6I22.10.88.H11.1.454.CMB.2.raw
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtggggcctcagtgaagatctcctgcgagtcttctggttactaccttacactatgcatctcgtgggtcgcgacgaccggccccgtggaacaagggtacgttggaggggttgggggtggggggttgggtcgaggtccgtacgtttaaccgtaaggtttcggactaacaactaaaagtttagngacaacgtaagtaaacgttacccgaagggaccaagggtacgtacaacctagtacgaacccgaacaacgaaccaacactacccaacgaacgaccaacacgacctaacgagtaacggaacgtagggggaacggtacgtacccgtaggacgtacgtcgtacggaaccgaaccgtaccgggtaccttaacgtttcgtttcgtacggccggtaccggttaaaggtaaacggtaaacggttaaaacgggttcgggttaaccggggtttaacgggttaccggggttaaccggggggaactacgttaacgggtaacggaaccggtaaccccgggg

SEQ ID NO: 440444 - DNA, 693 bp, Homo sapiens
  misc_feature: GZ8MTXP01DA3BZ.10.88.H11.1.454.CMB.2.raw
  modified_base (223)..(223): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgccgtggggcctnagtgaagatctcgtgcgaggtcttcgtaggttacctacctttaacacctagtcggctatctccgtgggtcgcgacgacggcccctagggaacaaggtcgttggagggtgggggtgggggtggtcaggccgtacttaaccgaagttcggacctaacaacttaaaattgtagacaaacgtaaggtaaacgttcccgaaggaccaaggtacgtacaccgatacgaaccacagacacacaccgaacgacgacacacgacctaacgatacggaactagggggaacggacgtaccgtaggagtacgtacgtacggacccgaacgtaccgggtacccgttaattcgtttaacgtcggacgggacgaaaggtaaacgggtaaacggttaaaaggttcgggttaacgggttaacggggttaaccgggttaacccggggggaactacggttaacgttaacgggaacccggtaacccgggg

SEQ ID NO: 440445 - DNA, 713 bp, Homo sapiens
  misc_feature: GZ8MTXP01AVPKP.10.88.H11.1.454.CMB.2.raw
  modified_base (389)..(389): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcgagtcgtggggctggaggtgaagagcccgtggggcctcgagtgaagatctcctgcgaggtcttctggttactaccttaacacctagtgcatctcgtgggtcgcgacgcggccccctggacgaggtacttggagggtgggggtgggggtggtcgaggccgtacgttaaccgaaggtttcggacctaaacgaacgtaaaatttanaggaccaacgaaggtaaaacgttcccgaagggaacaacgggtaacgtacccaaccagtaccgaacccaacgaacgaacaaccacgtacccgaacgtaacgccaaacgacgacccttaaacgagtaacgggaacttacgggggaacggacgtccgtaggaagacgttcgtacggaaccgtaaccgaccgggtcccgttaagttcgtttccgaggaccggtacggaaaggtaacggtaaaccgggttaaaaggttcgggttaacggtttaaggggtacgggtaacccgggggtaacacgttaggtccggaaccgtaaccccggggg

SEQ ID NO: 440446 - DNA, 705 bp, Homo sapiens
  misc_feature: GZ8MTXP01BVHB7.10.88.H11.1.454.CMB.2.raw
  modified_base (382)..(382): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagagcccgtggggcctcagtgaagatctcctgcgaggtcttctggttactacctttaacacctatggcatctccgtgggtcgcgacgacggcccctaggaccaaaggtcttggaggtgggggtgggggtggtcaggcgtcttaccgaagtttcggactaacgaactaaatttgngaccaacgtaggtaaaacgttcccgaagggtacaaggtacgtaccacatacgggaacccacagaaccacactacccgacgacggacaacgacgacctacagttacggaaaccgtggggaacgggacgaccgtagacgtagtaccgtacggaaccgaaccggtacgggtaccggttaactttcggtttaaccgttcgggccggaccgggaaaggtaaacgggtaaacggttaaaacgggttagggttaccggggttaacggggttacgggtttaacccggggggaacacggttaacggtaacgggaacccggttaacccggggg

SEQ ID NO: 440447 - DNA, 702 bp, Homo sapiens
  misc_feature: GZ8MTXP01DN3PB.10.88.H11.1.454.CMB.2.raw
  modified_base (517)..(517): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggattggacctggagcatccttttcttggtggcagcagcaacaggtgcccactcccaggttcagctggtgcagtcgtggggctggaggtgaagacgcccgtgggggcctcgagtgaagactctccgtgcgaggtcttcgtggttaacctaacctttaacacctatggcatcctccgtgggtcgcgacgacggtccctcgtaggaaaccgaagggtacgtttgggacggggttggggggtcgggggttgggtacgagggtccgtaccgttaaccgtaaaggtttcggactaaccgtaaacctaaaagtttatcggactaaccgtaaaaggtaacgtttcccgaaaggaacgaagtaacgtaccacccgaatacgaaccacgaagacaacactaccaaacgganacacacgacctaacagtagaacggtagagggacacgtagagtatcgaacggaccgaaccgacggtaccttaagttaacgtttcgcggaccgacggtaaaggaacggttaaaacggttaaaggttacggtaagggttacgggttaacgggttacccgggggacaaccgtaagaacggtaaccccgg

SEQ ID NO: 440448 - DNA, 651 bp, Homo sapiens
  misc_feature: GZ8MTXP01D3C2W.10.88.H11.1.454.CMB.2.raw
  modified_base (395)..(395): a, c, t, g, unknown or other
  modified_base (555)..(555): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgcccgtggggcctcgagtgaagatctcctgcgaggtcttcgtaggttacctaacctttaacaccttagtcggacagtcctccgtggggtcgacgaccgacggtccccctaggacaaggtacgttggaggtggggtgggggtggtcagtcgtacttacgaaggtttcgactaacgaactaaatttngacaacgagtaaaacgttcgaagacacggtactacaactgacacaacgacacactaccacgaagacacgacactacagtacgtaagacgaggggagccgtagtagacgtcgtacgacggaaccgaccggtccgttaacgtttacgttccgttaagccggnggaaacgaagggtaaacgtaaaggttacggttggttaccgggtttaaggtaccgggggtaacgacacgttacgggtaacccgccggtaaccggggg

SEQ ID NO: 440449 - DNA, 713 bp, Homo sapiens
  misc_feature: GZ8MTXP01BKN4S.10.88.H11.1.454.CMB.2.raw
  modified_base (512)..(512): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatcctccgtgcggaggtcttctggttacctacctttaacacctagtggctatcctcgtgggtgccgacgacggcccccgtggaacaaaggtatggaggtgggggtgggggtggtcaggcgtacttaccgtaaggttcggactacaacgtaaattatggacaacgaaggtaaaacgttacccgaagggacaagggtacgtaccaacctagtacgaacccaacagtaaccacactaccgaacgaacgacaacaacgacccttaacgaacgtacggtaaccgngggggaaaggacggacccgttaaggaacgtacgtaccggtagaacccggaacgtacccggggtacctttaagttaaccgttttcgacggttcccgggaacggaaaggaaacgggtaaacggttaaaaagggttcggttaaccggttaaggggttaccgggtaaccgggggtacacgttagtccggaaccgtaacccggggg

SEQ ID NO: 440450 - DNA, 690 bp, Homo sapiens
  misc_feature: GZ8MTXP01DWUS6.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcgagtgaagatctccgtgcgagtcttctggttacctaccttaacactagtggctatcctcgtgggtcgacgtaccgacggcccctaggaacgaaaggtcttggagggtgggggtggggtggtcagtcgtacttaccgaggtttcggactaaacaacgtaaattgtacgactaacgaacggtaaaacgttcccgaaggggacaaacgggtaacgtaccaaccgtagtaccggaaacccaacaacgaaccacaacaccgaacgacgtacaacacgacctaacgaacgttaaggaaccgtaggggaacgggtacgaccgtagtaagtacgtcggtaacggaaccgtacggtaccgggttacttacttcgtttcgcgacggtacggaagaacggtaacggttaaaggttcggttaacggtggggttacgggtaaccggggactacgacgtaaccggaacgtaacccgggg

SEQ ID NO: 440451 - DNA, 731 bp, Homo sapiens
  misc_feature: GZ8MTXP01B0WVV.10.88.H11.1.454.CMB.2.raw
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtgggggcctcgagtgaagatctcctgcgaggtcttcgtggttacacctttaacaccttatggcatctccgtgggtcgcgacacggcccctaggacaaggtcttggaggttgggggtgggggtggtcaggcgtcttaaccgaagttcggactaacgaactaaaattntgacaaccgagtaaaacgttacccgaagggtaaccaagggtaactccaaccctatacgggaacccaacacgaacaactactaccgaacgaacgacaacacgaccctaacaacgtacgggaaaccgtagggggaacggacggtaccgtacggaacgtacgtacgtacggaacccggaaccgtaacccgggtaccgttaacgttaacttttccgtacggttccggtaacgggaacgtaaacgggtaaaccgggttaaaagggttcggggttaaccgggttaagggggttaacggtttaacccgggggggtaacaacggttacggtaaccgggttaacccggtaacccggggg

SEQ ID NO: 440452 - DNA, 669 bp, Homo sapiens
  misc_feature: GZ8MTXP01B9GC5.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctcctgcgaggtcttctggttacctacctttaacacctagtggcatctccgtgggtcgcgacgacggccccgtggacaaggtacttggagggttgggggtgggggtgggtcaggtccgactttaccgaaggtttggactaacaactaaattatgacaacgaagtaaacgttacccgaaggacaagagtaccacagtacgaccacagacacataccagacgacacgacgacctacaagtacggaacgtggggaaggacgccgtagacgtactcgacgaaccgacgtaccggtaccgttaattacgtttcgcggacggtaccggaaggtaaacggtaaacggttaaaacgggttcggttaacgggttaacggggttaacgggtttaacccggggggaactaccggttaacgttaacggaacccggtaacccgggggg

SEQ ID NO: 440453 - DNA, 748 bp, Homo sapiens
  misc_feature: GZ8MTXP01AYVY2.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagtatctccgtgcgaggtcttcgtggttacctacctttaacacctagtcggcatcgtccgtgggtcgcgacgcggccccgtaggaacgaaggtacgttggaggggttcgggggtgggggtcgggtacgaggccgtaccgtttaaccgaggtttcgactaacaactaaattgcgacaacgaagtaaacgttaccgaagggtacaggtacgtaccaactagtacgaacccaacaacgaaccaactaaccgaccgaacgaacgaccaaccgacgaccctaacaacgtacgggaaaccgtaggggaacgggacgtaccgtaggaacgtacgtacgttacggaaaccggtaacggtaacccgggtaccgttaacgttaacgtttcgtacggaccgggtaccggaaaggtaaacgggttaaaaccgggttaaaagggttgggttaacccgggttaaggggtaaccggggtttaaccggggggaactaacggttaacggtcgggttaacccgtaacccggggg

SEQ ID NO: 440454 - DNA, 668 bp, Homo sapiens
  misc_feature: GZ8MTXP01DQHUI.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacctacctttaacacctatggcatcctccgtgggtcgacgacgacggccccctaggacaaaggactttggaggtgggggtggggtggtcagcgtacttacgaagtttcggactacaacaaattatcgacaacgaagtaaacgttcccgaaggtaccaaagtacgtaccaaccagtacgacccaacagacacactaccacgagcacacgacctacagtacggaacgtaggggaaacgggacgaccgtaggaagtacgttaccgtaggaaacccgaaccgtaaccgggtacccgttaacgtttacgtttaacgtcgttaccggacggaacggtaaaggtaacggttaaaaaggttcggttaacggttgggttaacgggttccggggggaactacggttataacggaaccgtaaccgggg

SEQ ID NO: 440455 - DNA, 695 bp, Homo sapiens
  misc_feature: GZ8MTXP01ATIQ1.10.88.H11.1.454.CMB.2.raw
  modified_base (388)..(388): a, c, t, g, unknown or other
  modified_base (393)..(393): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatcctccgtgcgaggtcttctacggttacctaacctttaacacctagtcggctatcctcgtgggtcgccgacgaccggcccctggacaagggtacttggaggtgggggtgggggtggtcaggcgtacttaccgaggttcggactaacactaaattnagcanagtaaacgttcgaaggacagactaccacctatacgacccacacgaactacactacccgagacgacacacgcctacgagtagaacgtggggaaggacgtccgtagacgtacgacgtacggaaccggaccgtaacccgggtaccgtttaacgttacgtttccgacgggttacggacggttaaacggtaaacggttaaacccgggttaaaaggttcggggttaaccggggtttaagggggttacccggggttaacccggggggaaacctacggaaccggttaacggaaccccggtaacccggggg

SEQ ID NO: 440456 - DNA, 779 bp, Homo sapiens
  misc_feature: GZ8MTXP01A0VY7.10.88.H11.1.454.CMB.2.raw
  modified_base (269)..(269): a, c, t, g, unknown or other
tcagcatagtagtgcacgaccggtgctcgatttagcgacagcgagaacacacaaagggacccaaaaaccacacccctcctgggagaatcccctagatcacagctcctcaccatggactggacctggagcatccttttcttggtggcagcagcaacaggtgcccactcccaggttcagctggtgcagtctggggctggaggtgaagacgcccgtggggcctcgagtgaagtatcctcctgcgaggtcttcgtggttacctacctttaacncctagtcggctatcctccgtgggtcgccgacgacggcccctaggaaccgaaggtacgttagggagggttgggggtgggggtcgggtcgacggtcgtccgttaaccgtaaggtttcggaccttaacgaaacttaaatttacgtagaccgaaacgtaacggtaaacgttacccgaaggaacgaggtacgtaccaaccgactacggaacccacaacgaaccacaactacccgaacggacgaccaacacgaccctaaccgaagtacggaaccgtaggggaacggtacgcccgtaggaacgacgtacgtacggaaacccggaccgtaaccgggttacccgttaaacgtttaccgtttaacggtacggttaccggaccggttaaaaggtaaacggtaaaaccgggtttaaaacggttccgggttaaaccgggttaacgggggttaaccgggtttaacccggggggaaacctaacggttaaccggtaaccgggttaaaccccggttaaccccggggg

SEQ ID NO: 440457 - DNA, 607 bp, Homo sapiens
  misc_feature: GZ8MTXP01EQN4S.10.88.H11.1.454.CMB.2.raw
  modified_base (375)..(375): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtctttctggttaacctacctttaaacacctatggcatcctccgtggggtgcgacacggccccctggacaaggcttggaggtggggtgggggtggtcaggcgtcttaccgaagtttcggactacaactaaacttngacacagtaaacgttccaaggacagagtcaaccatcgaacccacagacacactaccacgacgacaacacgacctaaccagtacggaactaggggacggacgccgtagagactcgtagaccgacgtaccggtaccgtattagttcgtcgcggacggaagtacggtaaacgttaaaacggttggacggttaagggtacggttaaccgggggacacgacgtcgaacgtaaccggg

SEQ ID NO: 440458 - DNA, 633 bp, Homo sapiens
  misc_feature: GZ8MTXP01CG6YL.10.88.H11.1.454.CMB.2.raw
  modified_base (542)..(542): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagagcccgtggggcctcagtgaagatctctgcgaggtcttctggttactaccttaacacctatggcatctccgtgggtcgcgacgacggccccctaggacaaggacttggaggtgggggtgggggtggtcgaggcgtcttaaccgaaggttggactaacaactaaattatgacaacgtagtaaaacgttcccaaggacaaggacgtcaaccatcgaaccacaacgaacaacaactacccaacgaacgaccaacgacgacccttaacaagtaggaaacgtaggggaaggacgccgtagagatctacgacgacgtacggtaccgtattactttcgngcggacgaaggaaagtaacgggttaaaaaggttcggttaacgggtgggttacgggttaaccgggggactacgagtcgaaccgtaaccgggg

SEQ ID NO: 440459 - DNA, 732 bp, Homo sapiens
  misc_feature: GZ8MTXP01BC89C.10.88.H11.1.454.CMB.2.raw
  modified_base (428)..(428): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgccgtgggcctcagtgaagatctctgcgagtcttctgttacaccttaacactatggcatctccgtgggtcgcgacgacggccccctaggaacgaaggtcgttggagggtgggggtgggggtcgggtcaggccgtacttaaccgaggttcggactaacaactaaattatgaccacgaacggtaaacgttccgaaggacagacgtccacatacgaacccanacgacacactacccgaacgacgactaacgacgtaccctaacgtagtacgggaaccgtagggggaacggacgaccgtaggaacgacgttccgtacggaacccggtaaccgtaccgggtacccgttaacgtttactttaacggtacggccggacgggttaaacgggtaaaacgggtaaacgggtttaaaaaacgggttcggggttaaaccggggtttaacgggggttaaacccgggggttaaccccggggggtaaacgtacccggttaacgggtaacccgggttaacccgggtaaaccccgggggg

SEQ ID NO: 440460 - DNA, 634 bp, Homo sapiens
  misc_feature: GZ8MTXP01EO2EH.10.88.H11.1.454.CMB.2.raw
  modified_base (364)..(364): a, c, t, g, unknown or other
  modified_base (407)..(407): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttactacctttaacacctatggcatctcctgggtcgcgacgacggccccctggacaaaggcttggaggtggggtgggggtggtcagcgtcttacaagttggactacactaaattntgcacagtaaacgttccaaggacagacgtcaccatcgaaccanagacacactaccacgaagcacacgctaacataggaactaggggaaggacgccgtagacgtatcgtacggaccgtacaccgggtaccgttattacgtttaacgtcgaccggacggaaaggaaccggtaaaaggttaaaacgggttcgggttaaacgggttaacggggttaacggtttaacccggggggaacaacccggttaaggttaacggaacccggtaacccgggg

SEQ ID NO: 440461 - DNA, 746 bp, Homo sapiens
  misc_feature: GZ8MTXP01CMRI3.10.88.H11.1.454.CMB.2.raw
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacggcccgtggggcctgagtgaagatctcctgcgaggtcttcgtggttactacctttaacacctagtggctatctccgtgggtgaccgacgacggcccctaggacaaaggtcgttggaggggttgggggtgggggtggtcaaggccgtacttaaccgaaggttggacttaacaactaaaatttngacaacgtaaggtaaacgttccgaaggaacaaggtaacgtaccaacctaagtcgaaacccaacaacgaacaacacacccaacgacgaccaaccgacgaccctaacgaacgtacgggtaaaccgtaggggaacggggtacgacccgttacggaaggacttaccgtacggaaacccgaaccggtaaccgggtaccgttaacttacgttttaaccgtcgggttaccggaccgggttaaaggaaacgggtaaaaccggttaaaaggggttcgggttaacgggtttaacggggtaaccggggttaacccggggggaaactacgttaacggtaaccggttaaccggtaaccccggggg

SEQ ID NO: 440462 - DNA, 625 bp, Homo sapiens
  misc_feature: GZ8MTXP01E2OWX.10.88.H11.1.454.CMB.2.raw
  modified_base (369)..(369): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggcttctggttacaccttaacacctatggcatctcgtgggtgcgacacggccccgtggaacaaggtcttggaggtgggggtgggggtggtcaggcgcttaaccgaaggtttcggactacaactaaattngcaacagtaaacgttccaaggacagacgtcaccatcgaccacacgacacactaccacgacgacacacgacctacagtacggaacgtggggacggacgcccgtagacgagtccgtaggacgaccgaccgggtaccgtacttaacgtttcgtggaccgcggaaaggaacggtaaacggttaaaaggttcggttacgggttaacggggtaccgggttaaccggggggaacacgacgttaaccggaaccgtaacccgggg

SEQ ID NO: 440463 - DNA, 781 bp, Homo sapiens
  misc_feature: GZ8MTXP01AMCYJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctccgtgcgaggtcttctggttactacctttaacacctatggctatctccgtgggtgccgacgacggccccctagggacaagggtcttggagggttgggggtgggggtgggtcaggccgtacgtttaaccgaaggtttcggacttaacgaactaaaatttacgtaggaccaaacgtaaggtaaaacgtttaccccgaagggggaaaccctaagggtaacgttacccaaccccgtaagttaccgggaaaccccaaaccgaacggaaaccaaccgaaaccttaccccgaaccggaacggacccaaaccgaacggtaccccttaaaccgaacggttaacggggaaaccgttagggggaacggggaacggtacccgttaggaacgtacgttaccgtacggaacccggaaccgtacccgggtaccgttaacgtttaacgtttcgtcggcggtaccggaaggtaaacgggtaaacggttaaaagggttcggttaacgggttaaggggttaacgggttaaccggggggactacgacgtaacggaacgtaacccgggg

SEQ ID NO: 440464 - DNA, 689 bp, Homo sapiens
  misc_feature: GZ8MTXP01BTXFX.10.88.H11.1.454.CMB.2.raw
  modified_base (372)..(372): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccgtggggcctcagtgaagatctcctgcgaggtcttctggttactacctttaacacctatggcatctccgtgggtcgacgacgacggcccctaggacaaaggtcttggaggtgggggtgggggtgggtcaggcgtcttaaccgaggttggactacactaaattntgacaacaggaaacgttcccaagggacagacgtcaacctatcgaaccacacgaacacgaactccgaacgaagaccaacacgaccttaacaagttaggaaccgtggggaaggacgtccgtaggtaacgacgtacgtacggaaccgtaaccggtaccggggtacccttaagtttacgtttaaccgtacgggttccggtaccgggaaggtaaacggtaaacgggttaaaacgggttcggggttaacgggttaacgggggtttaacgggttaacccggggggaacctaacgacggttaaccggaaccggtaaccccggggg

SEQ ID NO: 440465 - DNA, 704 bp, Homo sapiens
  misc_feature: GZ8MTXP01DSNLW.10.88.H11.1.454.CMB.2.raw
  modified_base (224)..(224): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctnagtgaagatctctgcgaggtcttctaggttactaccttaacacctatggcatctcgtgggtgacgacgacggcccccgtaggaacgaaaggtacgttggagggttgggggtaggggggtgggtcgaggtccggtacgtttaaccgtaaaggttcggactaacgaactaaaatttatacgacaacgtaagtaaaacgttaccgaagggtaacagaacgtcaacccagtacgaaacccacgaacgaacaacgactacccgaaacggacaccaacgacgaccctaacgagttacgggaaacgtacggggaaggacgtacccgtaggacgtagtccgaggaaccgaccgtaccgggtacccgttattacgttcgtacgccggacggaaggtaaacgtaacggttaaaaaggttcgggttaacgggttgggttaacgggttccggggggaactacgttaacgtaacggttaaccgtaacccgggg

SEQ ID NO: 440466 - DNA, 809 bp, Homo sapiens
  misc_feature: GZ8MTXP01A5UMW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgcccgtgggggcctcgagtgaagatctcctgcgaggtcttcgtaggttacctaccgtttaacacccttagtcggactacgtccgtacggtgggtcgacgacgaccggtccccgtaggaacgaaggtacgttaggtacgggggttgggggttcgggggtcggtacgacggtccggttacgttaaccggtaggtttacggaaccttaacgaaacgttaaaacgtttgtacggaaccgtaaacgtaaacggttaaaaccgttacccggaaggggtaaaccgtaaacgggtaaccgttaccccaaaccgttacggtaaacccgaaaccccaaacgaacgaaacctaaccaccgttaacccgaaacgggaaccgaaccaaccgaaccgtaccctaaacgtaacgtaaacgggtaaccggagggggaacggaccggtaccgtaggacgttacgtcgtaacggacgaccgtaccgggttaccttaagttcgttcgacgggcgtaacggaagtaaacggtaaacggttaaaggttcgggttaacgggttaacggggtacggggtaaccgggggaacacggttacggtaaccgaaccgggtaacccgggg

SEQ ID NO: 440467 - DNA, 742 bp, Homo sapiens
  misc_feature: GZ8MTXP01DFDVL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctccgtgcgaggtcttcgtaggttacctacctttaacacctagtggcatcctccgtgggtcgacgacgacggccccctaggaacgaaaggtacttggaggtgggggtgggggtgggtcaggccgtacttaaccgaagtttcggactaacgaactaaaattagtgactaacgaaggtaaaacgttcccgaaggggacaaggtaacgtaccaaccctagtacgaaacccaacaacgaacaacaacacccgaacgaacgaccaacgaacgaccctaacgaacgtacgggaaaccgtagggggaacgggtaacgtcccgtaaggaacgtacgtaccgtacggaaacccggaaccgtaaccgggtaaccggttaactttaacgtttccggtacggaccgggtaacggaaaggtaaacggtaaaaccgggttaaaaggttcgggttaaccgggttaaggggtaacgggttaacccgggggaacttacggacgttaacggaaccgtaacccggggg

SEQ ID NO: 440468 - DNA, 722 bp, Homo sapiens
  misc_feature: GZ8MTXP01BI27U.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagtatctcctgcggaggtcttcgtggttaacctacctttaacaccttatcggctatctcgtgggtcgcgacacggcccctggacaaggtacttggaggttgggggtgggggtgggtcaggccgtactttaaccgaggttcggactaacaactaaaatttgcgacaacgaagtaaacgttacccgaagggacaggagtaccaaccagtacgaacccacagaccacactaccgacgacgacacacgacctaacagtacggaaccgtagggggaaggtacggtaccgtaggtaagtacgttacgtacggaaccggtaaccgtacccgggtaccgtttaagttaaccgtttaacggtcgggttaccggaccggaaagggtaaacgggtaaaccggttaaaagggttccggggttaacgggtttaacggggttaccggggtttaacccggggggaactaccgggttaacggtaacgggttaacccggtaaccccggggg

SEQ ID NO: 440469 - DNA, 661 bp, Homo sapiens
  misc_feature: GZ8MTXP01A7PB8.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctcctgggtgcgacaggcccctggacaaggctgaggtgggtgggtggtcagcgcttaccgaaggttcggactacgacaaaacttgtgactacaggtaaacgttcccgaaggtacaggagtcaacccatcgaccacagacacactccaacgagaccacacgaccctacgacgtagggtaaccgtaggggaacggggaggacccgtaggacgagtaccgtaggaaccgaccgaccgggtccggtaaattacgtttaaccggtacggaccgggaccgggaaaggaaacggtaaacccggttaaaaaggttcgggttaaaccgggttaaggggttaacgggtttaacccggggggaactaaccggaacgttaacggaaacccgtaacccgggg

SEQ ID NO: 440470 - DNA, 698 bp, Homo sapiens
  misc_feature: GZ8MTXP01EBHXV.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcgagtcgtggggctggaggtgaagcgccgtggggcctgagtgaagatctccgtgcgaggtcttcgtggttaacctaacctttaacaccttagtcggactatcctccgtgggtcaccgacgaccggcccctaggaacgaaaggtcgttggagggtggggtggggtggtcaggccgtacttaacgaaggttcgactaacaactaaatttcgagacaacgaaggtaaaacgttccgaagggaaccagacgtaccaaccagtacgaaccaacaacgaaccaacactacccgaacgacgaccaacacgacctaacgaacgtacggaacgtaggggaacggacgtaccgtaggaagacgttacgacggaaaccgacgtaccggtaccgttaacttacgttcgtacggacggaacggaaaggaaacggtaaacggttaaaaggttcggttaaccgggttaagggttacgggttaaccgggggaacacggttacgtaaccggaaccggtaacccgggg

SEQ ID NO: 440471 - DNA, 614 bp, Homo sapiens
  misc_feature: GZ8MTXP01BYAL8.10.88.H11.1.454.CMB.2.raw
  modified_base (286)..(286): a, c, t, g, unknown or other
  modified_base (291)..(291): a, c, t, g, unknown or other
  modified_base (355)..(355): a, c, t, g, unknown or other
  modified_base (402)..(402): a, c, t, g, unknown or other
tcagcatagtagtgcacgaccggtgctcgatttagcgacagcgagaacacacaaagaggacccaaaaaccacacccctccttgggagaatcccctagatcacagctcctcaccatggactggacctggagcattccttttcttagtggcagcagcaacaggtgcccactcccaggttcagctggtgcagtcgtggggctggaggtgaagcgcccgtggggcctgagtgaagtatctctgcgaggtcttcgtaggttaccactttaacactatggcatctcgtggtncgacncggccctggacaggtctggaggtggggtgggtggtcagcgtcttacagtgactacaactaattngacacgaagtaacgttccgaagggacagacgtcaaccatacgaccanacgacacactaccgaacgacgacacgacgcctaacagtacggaacggtaggaagggacgacctaggaacgtacgtaccgtacggaaccgtaccggaccggttccgttaattaacgtttacgcggcggttacgaaggtaacggttaacgttaaaggttcggtaacggttgggtaacgggtaccgggggacttacgtcgttaacggtaacccgg

SEQ ID NO: 440472 - DNA, 677 bp, Homo sapiens
  misc_feature: GZ8MTXP01BT5F2.10.88.H11.1.454.CMB.2.raw
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagcccgtggggcctcgagtgaagatctcctgcgaggtcttctggttactaccttaacacctatggcatctccgtgggtcgcgacgacggcccctaggacaaaggtctggaggtgggggtgggggtgggtcagccgactttaaccgaaggtttcggactaacaacgtaaaatttagngacaacgaaggtaaaacgttcccaagggtacaaggaacgtaccaacctatacgaacccaacaacgaacaacaactaccaaacgacgacaacacgaccctaacgaatagggaaaccgtggggaacggtacgaccgtaggacgtaacgtcgacggaaacgaccgtacggtacccgttaattagttcgtggacgacggaagaaacggtaaacgttaaaacggttcggttacgggttaagggttaacgggttaaccggggggaactacgttaacggtaacggaaccgtaacccggggg

SEQ ID NO: 440473 - DNA, 670 bp, Homo sapiens
  misc_feature: GZ8MTXP01D6FA0.10.88.H11.1.454.CMB.2.raw
  modified_base (399)..(399): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaaggacgcccgtggggcctcgagtgaagatctcctgcgaggtcttcgtcggttaacctaacctttaacacctagtcggctatccgtccgtgggtcgcgacgacggcccctgggaacaagggtcgttggagggttgggggtgggggtgggtcaggtccgtacttaccgaaggtttcggactaacaactaaattntgacacgtaagtaaacgttaccaagggacaggacgtaccaacatacgaaccaacacgaacaacactaccaacgacgacaacacgtacctaacaagtacggaacgtagggggaacggacggtaccgtaggagacgttacgtacggaaccgacgtaccggtaccgttattacgtttcgtcgcggacggaaggaaacggtaaacggttaaaggttcggacgggttaagggtacgggttccgggggacacgttagtaacggaaccgtaacccggg

SEQ ID NO: 440474 - DNA, 709 bp, Homo sapiens
  misc_feature: GZ8MTXP01B9CNA.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacaccttacacctatggcatctccgtgggtgcgacgacggccccgtggacaaggtcttggaggtgggggtgggggtggtcgaggcgtacttaccgaaggttcggactacaactaaattatcgacacgaaggtaaaacgtttcccgaagggtacaggacgtcaaccagtacgaacccacagacacactaccgacgacgaccaacgacgtaccctaacgagttacgggaacgttacggggaacgggacggtacccgttagggaacgtacgttaccgtacggaaacccggaccgtaaccgggtacccgttaagtttaacgtttccgtacggttccggaccgggttaaaggtaaacgggtaaccggttaaaaagggttcgggttaacggggtttaaggggttaaccggggtttaaccggggggaactacggttaacggtaacggaaccggtaaccccggggg

SEQ ID NO: 440475 - DNA, 637 bp, Homo sapiens
  misc_feature: GZ8MTXP01AMAFO.10.88.H11.1.454.CMB.2.raw
  modified_base (553)..(553): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcagtgaagatctcctgcgaggtcttctggttactacctttaacacctagtggcatctccgtgggtcgcgacgacggcccctaggacaagggtacttggaggtgggggtgggggtggtcaggtccgacgttaaccgaggtttcggactaacgaactaaatttgtgaccaacgaggtaaaacgttcccgaaggacagacgtccacatacgaacccacaacgacaacactacccacgacgaccaacgacgacctaacgagtacggaaccgagggggaggacgtccgtagagacgtcgtacgaaccgaccgtaccggtacgttattagttcgnggacggacgaggaacgtaacgttaaaggttcgttacgggtgggtaacgggttccgggggacacgagtaacgaaccgtaaccggg

SEQ ID NO: 440476 - DNA, 728 bp, Homo sapiens
  misc_feature: GZ8MTXP01BD6XE.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcagtgaagatctcctgcgaggtcttcgtaggttacctacctttaacacctatggcatctccgtgggtgcgacgacggccccctggacaaggtcttggaggtgggggtgggggtggtcaggccgtcttaaccgaggttcggactacaactaaatttatggacaacgaaggtaaacgttccaagggacaggacgtccaacatcgaacccacagaacacactacccaagaacgaccaacacgacccttaacgacgtaacgggtaaaccgtagggggaacggggacgtaccccggttaggaacgtaacgttccgtacgggaaacccggtaccggtaacccgggttacccgtttaaagtttaacgttttccggtacggaccgggtaaccggaaagggtaaacgggtaaaaccgggttaaaaaggggttcggttaacggggtttaacgggttacggggtttaacccggggggaactaacggttacgttaaccggaaccggttaacccggggg

SEQ ID NO: 440477 - DNA, 653 bp, Homo sapiens
  misc_feature: GZ8MTXP01AEVJ0.10.88.H11.1.454.CMB.2.raw
  modified_base (370)..(370): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcgagtgaagatatcctgcgaggtcttctaggttactacctttaacacctatcggcatctcgtgggtgcgacacggcccctggacaaggtcttggaggtgggggtggggtggtcaggcgtcttaaccgagttcggactacaactaaattntgacacgagtaaaacgttccgaaggacaggacgtcaactatacgaccacacgacacactaccacgacgacaacgtacgacctacgaacgtacggaacgtacgggggaacgggacggaccgtacggaacgtactacgtacgaaccggtacgtaccgggtaccgttaacttacgtttccgtggttccggacggaaacggtaaacggtaaacggttaaacgggttaggttaccggtaagggtacgggtaaccgggggaacacgacgtaacggaaccgtaacccggg

SEQ ID NO: 440478 - DNA, 784 bp, Homo sapiens
  misc_feature: GZ8MTXP01ETROD.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtagaagatcctccgtggcgaggtctttcgtaggtttaacctaaccctttaaacaccttagtcggctactccgtccgtggggtcgaccgacgaccgggccccctagggaacaagggtacgttggaggggttgggggtgggggtggtcaggtccgtacgtttaaccgaaggtttcggactaacgaactaaaatttcgtgacaacgtaaggtaaaacgttcccgaagggtacaaggtacgtacccaaaccgatacggaaacccaacgaacgaaccaacactacccgaaacggaacgaccaacaacggtaccctaacgaacgtacggaaaccgtagggggaacgggacgtaccgtaggaacgtacgttaccgacggaaaccgaccggtaaccgggtaccgttaactttacgtttaacgtcggaccgggtaacggttaaaggtaaacgggtaaaccggttaaaagggttcggggttaaacggggttaacggggttaaccggggttaacccggggggaacctaacggttaacggttaaccgggaacccggtaacccggggg

SEQ ID NO: 440479 - DNA, 690 bp, Homo sapiens
  misc_feature: GZ8MTXP01BE4LS.10.88.H11.1.454.CMB.2.raw
  modified_base (248)..(248): a, c, t, g, unknown or other
  modified_base (266)..(266): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagcgtggtgcagtcgtggggctggaggtgaagcgccgtggggcctcgagtgaagatctctgcgagtcttntgttactacttacactangctatctcgtggtcgcgacgcggccccgtaggaccgaaggtcgttggagggtgggggtgggggtggtcgagtccggtacttacgtagttcggactaacgaactaaacttagtgacgaacgaagtaaacgttccgaagggacaggtactcaaccgagtacgaacccacgaacgaacaacactaccaacgacgacaacgacaccgtaacgagtaacgaacgtagggggaagtaccggtaccgtagaacgtacgtacgtacggaaaccgtaccgtaaccgggttaccgttaacgttactttcggacggacggtacggaaacgtaaacgggtaaacggttaaagggttcgggttaacgggttaacggggttaacggggttcccgggggaactaacggttacggttaaccggaaccgggtaacccgggg

SEQ ID NO: 440480 - DNA, 769 bp, Homo sapiens
  misc_feature: GZ8MTXP01EFDOJ.10.88.H11.1.454.CMB.2.raw
  modified_base (640)..(640): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagactctcgtgcgaggtcttcgtacggttaacctaacctttaacacctagtcggctactctccgtgggtcgaccgacgaccggccccgtaggaacgtaaaggtacgttgggaggggttcgggggtggggggttcgggtacgaggtcccgtactttaaccggaaggtttcggactaaacgtaaactaaaagtttcgtacgacctaacgtaacggttaaaacgttacccgaagggtaactaaagggtacttaccgaaccgtaagtacggaaaccccaagaacgaacctaacgacgacccgaacgacgaccaaccgaacgaccctaaagacgtaacgggaactgggggaacggacgtaccgtagagtacgtcgtacggaaccgaccgtacgggtaccttaattcgttaacgngggttaaccggagttaaacgggtaaacgtaaacgggttaaagggttcgggttaaacggggttaacgggttaaccggggtaaccgggggaactaacgttacggttaaccggaaccgggttaacccggggg

SEQ ID NO: 440481 - DNA, 643 bp, Homo sapiens
  misc_feature: GZ8MTXP01AQV0V.10.88.H11.1.454.CMB.2.raw
  modified_base (336)..(336): a, c, t, g, unknown or other
  modified_base (364)..(364): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatctcctgcgaggtcttctggttaaccacctttaaacaccctatggctatctccgtgggtgcgacacggcccctggacaaggacttggaggtggggtgggtggtcngcgcttacagttcggctacactaaattngcacagtaaaacgttccaaggactagacgtcaccatcgaaccacaagacaacactaccaacgagaccaacacgacctaacacgtacggaaactacggggaaggacggtccgtaggaacggtaatccgtaggaaccggaaccgtaccggggtaccgttaaacgttaacgtttctcgggacggtaccggaaaggtaaacggaaacggttaaaaggttacggttaaccggtaagggtacggttaaccggggggaactacgacgtaacgaacgtaacccgggg

SEQ ID NO: 440482 - DNA, 633 bp, Homo sapiens
  misc_feature: GZ8MTXP01BFJEK.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgccctggggcctcagtgaagatctcctgcgaggtcttctaggttacctacctttaacacctagtggcatctccgtgggtgcgacacggcccctggacaaggtcttggaggtggggtggggtggtcaggcgtacttaccgaagttcggacttacaacgtaaatttatgacaacgagtaaaacgtttcccaagggacagaacgtccaaccatacgacccaacaagaaccacactaccgaacgacgaccacacgacctacgaagtacggaacgtggggaagacgtccgtagaacgtatcgtgaaaccggacgtacgggtacccttaagttaactttcgcgcggtacggaacgaaggtaacgttaaaaggttcggttacggtaagggtacgggttaaccgggggactacgagtcgaacgtaacccggg

SEQ ID NO: 440483 - DNA, 719 bp, Homo sapiens
  misc_feature: GZ8MTXP01AQUPR.10.88.H11.1.454.CMB.2.raw
  modified_base (394)..(394): a, c, t, g, unknown or other
  modified_base (454)..(454): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctgagtgaagatctccgtgcgtaggtctttcgtaggttaacctaaccctttaacaccctatggcatcctccgtgggtcacgacgacggcccctggacaaggtacttggagggtgggggtgggggtgggtcaggcgtcttaccgaagtttcggactaaacgactaaaatttagngtacaacgagaaaacgtttcccgaaggacagacgtacacatcgaacccacagaacacacnccaacgacgcaacacgcctaacagtacgaacgtggggaacggacgtaccgtaggaacgtacttcgacggaaaccggtaccggtaacccggggtaccgtttaaacgtttaaggttttcccgtacgggaccggtacgggaaacgggtaaacgggtaaaacgggttaaaacggggttacggttaaccggggttaaggggttaaccgggggtttaacccgggggggaacctacggttaacggtccgggttaaccggttaaccccggggg

SEQ ID NO: 440484 - DNA, 734 bp, Homo sapiens
  misc_feature: GZ8MTXP01AFH32.10.88.H11.1.454.CMB.2.raw
  modified_base (280)..(280): a, c, t, g, unknown or other
  modified_base (519)..(519): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacggccgtggggcctcgagtgaagtactctccgtgcgaggtcttcgtggttacctacctttaacacctagnggctatctccgtgggtcgaccgacgacggccccgtaggacaaggtcgttggagggtgggggtgggggtggtcgaggcgtacttaaccgaaggtttcggactaaacaacgtaaaatttcgcggtaccaacgtaaggtaaaccgtttacccgaagggacaacggtacgttaccaaacctagacgaaacccaacgaacgaaccaacaccgtaccaacggacgacaaccgacgtacccgtaanacggtacgaaccgagggggaacggacgtccgtaaggaacgtacttccggacggtaacccggaacggtaccgggttaacccttagtttcgtttcccggaggaccggtaacggaaggtaaacgtaaacgggttaaaggttcggttaacgggggtaagggttaccgggggttaacccggggaactacgttacggtaacggaacccggtaacccggggg

SEQ ID NO: 440485 - DNA, 713 bp, Homo sapiens
  misc_feature: GZ8MTXP01B9E8A.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggagggtgaagacgcccgtgggggcctcgagtgaagatctcctgcgaggtcttctggttactaccttaacactatgcatcgtcgtggtcgcgacgacggcccctaggacgaaggtacgttggagggtgggggtgggggtggtcgaggtccgtacgtttaaccgaaaggtttcggactaaacaactaaaattagtagacaacgagtaaaacgttcccgaaggggaacaagggtaacgtccaaccgtagtacgaacccaacaagaaccaacactacccgaagacgaccaacacgccttaacgaagtagggaaacgttggggaagggtaacgccgtaggaagtactaccgtacggaaccgtacgtaaccgggtaccgttaattaacggtttccgaggacggtaaccgggaaagtaaacgggtaaaacgttaaaacgggttgggttaaccggggttggggttaaccgggttaaccggggggaactacggttacgtaacggaaccggtaaccccggggg

SEQ ID NO: 440486 - DNA, 713 bp, Homo sapiens
  misc_feature: GZ8MTXP01BA09P.10.88.H11.1.454.CMB.2.raw
  modified_base (288)..(288): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttcgtggttacctaccttacacctatggctatctcgtgggtcncgacgacggcccccgtaggacaaggtcgttggaggtgggggtggggtggtcaggtcgtcttaaccgagttcggactacaactaaattatgactaacgaaggtaaacgttccgaagggtacaagggtacgtaccaaccgtaagtacgaaacccacgaacgaacaactaactacccgaagaacgaccaacgaccgacctaacgacgtaacgggaaccgtagggggaaacggacggcccgtaggaggtactcgtacggaaccggaaccgtaacccgggtaccgttaacgttacgtttcgcggaccgggtacggaaacgggtaaacggtaaaccggttaaaagggttccgggttaacggggttaacggggtaacgggttaacccggggggaactacggttacgttaacgggaacccgtaaccccggggg

SEQ ID NO: 440487 - DNA, 823 bp, Homo sapiens
  misc_feature: GZ8MTXP01DT4VD.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctccgtgcggaggtcttcgttacggttacctaacctttaaaccacctagtcggctactccgtccgtgggtcgccggaacgaccgggcccccgtaggaaccgaaagggtaccgtttaggaggggttggggggtagggggttcgggggtacgaggtccggtaccgtttaaccgtaaggtttcgggacttaaaccgaaactaaaagtttatacggaccaaacgtaaggtaaaaccgtttacccgaagggaacgaaggtaaccggtacccaacccgtagttaccgaaacccaacgaacgtaacaacctacgtaccccgaacggaacgaccaacgaaccgtacccttaacaaacggttacggaaaccgttaggggaacgggaacgtcccgttaagggaacgtacgtaccggtaggaaaccggaaccgtaccggggtacccttagtttacgttcgtacggggccgtaaacgggaaacggtaaacggtaaacgggttaaaacgggttcgggttaaaccggggtgggggtttaaccggggtaaccccggggggtaactaaccgggttacgtaaccgggaacccggttaacccggggg

SEQ ID NO: 440488 - DNA, 708 bp, Homo sapiens
  misc_feature: GZ8MTXP01BSJCK.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgcccgtggggcctcgagtgaagatctcctgcgaggtcttctggttacctacctttaacacctagtggcatcctccgtgggtcgcgacgacggcccctaggacaaggtcttggaggtgggggtgggggtgggtcgaggccgtacgtttaaccgaggtttcggactaacgaactaaatttagtggaccaacgaaggtaaaacgttcccgaagggacaagggacgtaccaaccctagtacgaacccacaacgaaccaacaactaccgaacgacgaccacgaccgacctacgagtacggaaccgtaggggaacgggacgaccgtggaagtactcgtacggaaccgaccgtaccgggtacccgttaagttacgtttcgtcggccggtacggaaggtaaacgggtaaacggttaaaaggttcgggttaccgggttaagggggttaccgggttaacccggggggacgtaccggttacggtaaccggaacccggtaaccccggggg

SEQ ID NO: 440489 - DNA, 544 bp, Homo sapiens
  misc_feature: GZ8MTXP01DCFJX.10.88.H11.1.454.CMB.2.raw
  modified_base (355)..(355): a, c, t, g, unknown or other
  modified_base (427)..(427): a, c, t, g, unknown or other
  modified_base (476)..(476): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttaccacctttaacacctatggcatctcctgggtgcgacacggccccctggacaaaggacttggaggtggggtgggggtggtcagcgtctaccgaagttggctanactaaattatgcacagaaagttccaaggacagagtcaccatgaccacagacacatccacgagcacagcctanataggaactgggaaggagcctagagatcgtgacgactacggaccgtatnttctgcgacgagagaacggttaaaagttgacggtggtaacgtcgggggacacgatgaacgtaaccggg

SEQ ID NO: 440490 - DNA, 737 bp, Homo sapiens
  misc_feature: GZ8MTXP01AYT0H.10.88.H11.1.454.CMB.2.raw
  modified_base (197)..(197): a, c, t, g, unknown or other
  modified_base (509)..(509): a, c, t, g, unknown or other
  modified_base (526)..(526): a, c, t, g, unknown or other
  modified_base (694)..(694): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccacccttgttctttttcnccgaggggacagagtccaccctctccgtgtacgggcctagttagtggtgttggcgtaccttaatttaaacgtggtaaccaaacgaagaaacgtggaccaggcctcccgaggtcctcctacatccgtaacgaacgcaactccccaaccgacgggccctacgtcggcccgtaccccgaggccccgtaagggtttccgaagttcgggaccgtaggggttcggggttacccgtacgggggtaactaggtaccctttccgaaaaccttccctaacccaaccctatccgaacggtccaacgggtcccgtaggggaccncccgttaaggaaacgtnttaacgttgtaacgttaagtttttaatacgtttaggaccagacgtaaggtcgggttaagccgttaagggttccgttcccttttacgaccggtttccggggacccgggtaaactaaaggggtacgaaaactcgaaaacgtacgttggtacggctacggaccaaccgttnttcctgtttactccgttctcccgttaccccgcttaacgttccg

SEQ ID NO: 440491 - DNA, 658 bp, Homo sapiens
  misc_feature: GZ8MTXP01BYQPE.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctctgcgaggtcttctggttacctaccttaacactatgctatctccgtgggtgccgacgacggcccctagggacaagggtcttggagggttgggggtgggggtcgggtcaggtccgtcgttaaccgaggtttcggactaacaactaaattacgtagccaacgtagtaaaacgttcccgaagggacaaggacgtaccaacccgatacgaacccacacgaacacactaccacgacgacacacgacctacagtacggaacgtaggggaacggacgaccgtagacgtactcgtacggaaccgacgtaccggtacgttacttagttcgtcgccggtacggaaggaacggtaacggttaaaggttcgggttacgggttaagggttacgggtaaccgggggacacgttacgtaacggaaccggtaaccgggg

SEQ ID NO: 440492 - DNA, 732 bp, Homo sapiens
  misc_feature: GZ8MTXP01A6FVV.10.88.H11.1.454.CMB.2.raw
  modified_base (289)..(289): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggttaggtgaagagcccgtgggggcctcgagtgaagatctcctgcgaggtcttctggttacactttaacacctatggcatctccgtgggtcncgacgacggcccctggacaaggacttggaggttggggtggggtggtcaggcgtcttaccgaaggtttcggactacactaaattatcggacacgaggtaaaacgttcccgaagggtacacgtacgtccaacctagtacgaaccacgagaaccaacacgtcccaagacgaccaacgacgtacctaacgagttagggaaaccttgggggaacggaccggtaccgtagggaacgtaacgttccgtaacgggaaccccgtaacgtacccgggggtaccctttaaagttcgtttttaacccgacggggccggaaaccggaaagggtaaacggtaaaacccgggttaaaaaggttcgggttaaacccgggttaagggggttaacccggggtttaacccggggggaacttaacccggaagttaacccgggttaacccggtaaccccggggg

SEQ ID NO: 440493 - DNA, 687 bp, Homo sapiens
  misc_feature: GZ8MTXP01DL15X.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggagggtgaagacgcccgtgggggcctcgagtgaagatctcctgcgaggtcttcgtggttaacctaacctttaacacctatggcatctcgtgggtgcgacgcggcccctggaacaaggtcttggaggttgggggtggggtggtcagcgtacttaaccgaggtttgactaacaactaaatttagtcgacaacgtaaggtaaaacgttcccgaaggggaacaagggtaacgtaccaacccaagtacggaacccaacaacgaaccaacactaccgaacgaacgaccaaccacgaccctaacgaagtacgggaactaggggacgggacgtccgtagaagactcgtaggaaccggaaccgtaccggtacccgttattaacgtttcgtacgacggacgaaggaaacggtaaacggttaaaaggttcggttaaccgggttgggttaaccgggttccgggggaactacgttacgtaacggttaaccgtaacccgggg

SEQ ID NO: 440494 - DNA, 815 bp, Homo sapiens
  misc_feature: GZ8MTXP01ANLGB.10.88.H11.1.454.CMB.2.raw
  modified_base (226)..(226): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacgcccgtggggcctnagtgaagatctctgcgaggtcttcgtggttactaccttaacacctatggcactctccgtggggtcgccgacgacgggtcccccgtagggtaaccgaaagggtaccgtttggaagggggttggggggttggggggttaggggtaccgtaaggggtcccgttacccgtttaaaccggaaagggtttcgggaaccttaaacctaaacggtaaaaattttcggtgaacccgtaaacgtaaggtaaaaaacccggtttcccgaaggggaaacctaaacgggtacgttaccccgaaaccgtaacgtaacgggaaacccccaacgaacgtaaacccaactaaccgtcccgaacgaacggaccaacccgaacgtaacccttaaccgaagttaacgggaaaccgttagggggaaacggtacggtacccgtaggaacgtacgtcgttacggaacccgtacgaaccggtaccgttagtttacgttcgtcgacggacggttaacggtaaacggtaaaggttaaaggttcgggttaacggttcggggttaaccgggttccgggggaacctacgttacggttaacggaaccgtaacccggggg

SEQ ID NO: 440495 - DNA, 729 bp, Homo sapiens
  misc_feature: GZ8MTXP01DSHIG.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatctcgtgcgaggtcttctaggttaccactttaacacctatggctatctccgtgggtcacgacgacggcccctaggaacgaaaggtacgtttggagggttcgggggtgggggtcgggtacgaggtccgtactttaaccgaaggtttcggacctaacgaaacttaaaagttgtacggaccaaacgtaaggtaaaacgtttacccgaaggggaacctaacggtaacgttaacccaacccgtaagtacgaacccaacgaacgaacaactacaccgaacgaacgaccaaacgacgacccgtaaaacgtacgtaacggtaacgtacggggaacggacgtaccgtaggaacgtacgtcgtaacgaaccgaccgtaccgtacgttacttcgttcgcggacggaacggaaacggtaaacggtaaacggttaaaggttcgggttaacgggttaaggggtacgggtaaccggggaacacggttacggtaaccggaaccggtaaccggg

SEQ ID NO: 440496 - DNA, 699 bp, Homo sapiens
  misc_feature: GZ8MTXP01EHE30.10.88.H11.1.454.CMB.2.raw
  modified_base (292)..(292): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctccgtgcgaggtcttctggttacctacctttaacacctatggcatcctccgtgggtcncgacgacggccccctaggaccaaaggtcgttggaggtgggggtgggggtgggtacaggccgtacttaaccgaaggtttcggactaaccgaactaaaagtttcacggacaactaaggtaaaacgtttcccgaaggggtaaccaagggtacgtaccaaacccgtagtacggaaacccaacgacgaacaaccactacccgaacgacgacaacacgacctaacgagtaggaaccgtaggggaacggacgtaccgtaggagtactacgttacggaaccgaaccgtaccggtaccgttaacgttacgtttaacgtcgacggacggaaggaaacggtaaacggttaaaggttcggttacgggttaagggtacggttaaccgggggactacgagtaacggaaccgtaacccgggg

SEQ ID NO: 440497 - DNA, 701 bp, Homo sapiens
  misc_feature: GZ8MTXP01A2B14.10.88.H11.1.454.CMB.2.raw
  modified_base (276)..(276): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagatcctctgcgagtcttctggttactaccttaacactagtgcntctcgtgggtcgacgacgacggccccgtaggaacgaaggtcgttggaggggttgggggtgggggtggtacgaggtccgtacgttaaccgaggttcgactaactaactaaattagtgacaacgtaaggtaaacgttacccgaaggtaacaagtacgtacccaacacgtacgaaccacaacgacaacactaccgaagacgaccaacgacgaccctaagagtacggaaccgtggggaacggtacgtaccgtaggaacgtacgttacgtacgggaaaccgtaccgtaaccgggttcctttaatttccgtttaacgcgggttaccggaacggttaaggaaacgggtaaacgttaaagggttcggttacgggttaacggggttaccgggtaaccggggaactcggttaacgtccggaacccgtaaccgggg

SEQ ID NO: 440498 - DNA, 645 bp, Homo sapiens
  misc_feature: GZ8MTXP01BAD7S.10.88.H11.1.454.CMB.2.raw
  modified_base (241)..(241): a, c, t, g, unknown or other
  modified_base (264)..(264): a, c, t, g, unknown or other
  modified_base (269)..(269): a, c, t, g, unknown or other
  modified_base (374)..(374): a, c, t, g, unknown or other
  modified_base (461)..(461): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctctgcgnggtcttctggttacaccttaacncctanggctatcgtcgtgggtcgacgacgacggcccctaggacaaggtcgttggaggtggggtgggggtcggtcaggtcgtacttacgaagttcggactacactaaattntgacacgtaacgtaaaacgttcccaagggtacaagggtacgtaccaacagtacgaacccacacgacacactaccagacgacacgacnccgtacagtacgaacgtgggacggacgctaggatacgtcgtacgaaccgacgtaccggtaccttattacgttcgtacggcgtacggaacgtaacgggtaaacggttaaacggttcggttacgggttaagggtacggggttcccgggggaactaccggacgttaaccggaaccggtaacccgggg

SEQ ID NO: 440499 - DNA, 638 bp, Homo sapiens
  misc_feature: GZ8MTXP01EZF0J.10.88.H11.1.454.CMB.2.raw
  modified_base (365)..(365): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggtcttctggttacacctttaacacctatggcatctccgtgggtgcgacgacggccccctggacaaggctttggaggtgggggtgggggtggtcagcgcttaccgagttggctacgactaaattntgacacgagaaacgttccaaggacagagtccaccatcgacccacacgacacactaccacgacgcacacgacctacaagtaggaacgtacggggaggaacgccgtagagacgtcgtacgaccggaaccgtaccgggtacccgttagttaacttttccgttggccggacggaggaaacggtaaaccgggttaaaagggttcggttacgggttaaggggtacgggtttaacccgggggggaacacggttacgtaacggttaaccggtaacccgggg

SEQ ID NO: 440500 - DNA, 645 bp, Homo sapiens
  misc_feature: GZ8MTXP01ACKOZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggtcttctggttaccacctttaacacctatggcatctccgtgggtgcgacacggcccctggacaaggtacttggaggtggggtgggggtggtcaggcgtcttaaccgaagttggactacgactaaagttatgctaacaggtaaaacgttcccaagggacaggagtcaccatcgaaccacagaccacactaccacgacgacaacgacgacccttaacaagtacggaaccgtagggaacgggacgacccgttaggaacggacttcgtacggaaccggacgacccgggtacccggttattacgtttcgtcggaccggaccggaaggaaagggtaaccgttaaagggttcgttacgggtaagggtacggttccggggggaacacggttacgtcggaaccgtaacccgggg

SEQ ID NO: 440501 - DNA, 665 bp, Homo sapiens
  misc_feature: GZ8MTXP01BD6TE.10.88.H11.1.454.CMB.2.raw
  modified_base (389)..(389): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtcgtggggctggaggtgaagagcccgtggggcctcagtgaagatctctgcgaggtcttctggttactaccttaacacctatggctatcgtccgtgggtcgcgacgcggccccgtaggacaaggtcgttggagggtgggggtgggggtgggtcgacggtcgtacgtttaccgaaggttcggactaacgaactaaaagtttangacaacgtagtaaaacgttccgaagggtaacaaggtacgtaccaaccagtacgaaacccaacgaacgaacaacactaccgaacgacgaccaacgacgacctacgagtaggaacgtaggggacggacgtaccgagagtacgtcgtacgaacgacgtacggtacgtacgttagttcgcgcggacggaaggtaacggtaacggttaaaggttcggttaacgggttaacgggtacgggttaaccgggggactacggttacgtcggaaccgtaacccgggg

SEQ ID NO: 440502 - DNA, 638 bp, Homo sapiens
  misc_feature: GZ8MTXP01APLBL.10.88.H11.1.454.CMB.2.raw
  modified_base (221)..(221): a, c, t, g, unknown or other
  modified_base (229)..(229): a, c, t, g, unknown or other
  modified_base (396)..(396): a, c, t, g, unknown or other
  modified_base (428)..(428): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgccccactcccaggttcagctggtgcagtcgtggggctgaggtgaagagccctgggcctnagtgaagntctcctgcgtaggctttctggttacacctttaacacctagtggcatctccgtgggtcgcgtaccgacggtccccctggaacgaaggacgtttggacggttgggggtgggggtgggggttcgaggccgtacgttaaccgtaaggtttggacttaacgactaaatttangacacagaaagttccaagacagagtcacgtangaccacagacacactaccacgacgacaacacgacctacaagtaggaacctaggggaaggacgtacccgtggaacgaacgttcgacgaaccgaccgtaaccggtccggttaattacgtttcgtgccggacgttaaggaacggtaacggttaaagttcgggacggttgggtacggttaaccgggggacacggagtcggaacgtaaccccggg

SEQ ID NO: 440503 - DNA, 670 bp, Homo sapiens
  misc_feature: GZ8MTXP01AWUQM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggtcttcgtggttactacctttaacacctatggcatctccgtggtcgcgacacggccccgtggacaaggtacttggaggtgggggtgggggtggggtcaggcgtaccgttaaccgaaggttggactaacaactaaaattatcgacaacgaagaaacgttaccaagggacaagacgtaccaaccatcgaacccacacgaacacactacccaacgacgacaaccgacgaccctaacaagtaggtaaaccgtaggggaaggacgcccgtaggagtacttcgacggaaccgaacgacccggtaccgttaacttagtttctcggccggaaccggttaaggaaacgtaaacggttaaaacggttggaccgggttaagggtaacggtttaaccgggggaacacggttagtaacggttaaccggtaacccggggg

SEQ ID NO: 440504 - DNA, 718 bp, Homo sapiens
  misc_feature: GZ8MTXP01BNGCH.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctccgtgcgaggtcttctggttactacctttaacacctatggcatctccgtgggtcgcgacgcggcccctggacgaaggtcttggaggtgggggtggggtcgggtcacggccgtacgttaaccgaggtttcggactaacgaactaaaattacgtagaccgaacgtaagtaaacgttacccgaagggaccaaaggacgtacccaaccagtacgaacccaacgaacgaaccaacactacccgaacgaacgaccaacgacgaccctaacgacgtagggaaaccgttagggggaacggacggaccgtaggaagacgtaccgtacggaaccggaccgtaaccggtaccgttacgttacgtttcggtcggaccggtaacggacggtaaacggttaaacggttaaaaagggttcgggttaaccgggttaagggggtaaccggggtttccgggggaaccacggttacggtaaccggaacccggtaacccggggg

SEQ ID NO: 440505 - DNA, 659 bp, Homo sapiens
  misc_feature: GZ8MTXP01EIBRX.10.88.H11.1.454.CMB.2.raw
  modified_base (378)..(378): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagccctggggcctcagtgaagatctcctgcgaggtcttctggttaccacctttaacacctatggcatcctcgtgggtcgcgacacggcccctggacaaaggtcttggagggttggggtgggggtggtcgaggccgtcttaaccaaggttcggactaacgaactaaaatttntgacaacgaacgtaaaacgttcccgaagggaacaggaacgtccaaacctatacggaacccaacaacgaaccaacactacccgaacgaacgaccaaccagaccctaacaagtacggaaaccttagggggaacggaggtaccctaggaagacgttacgtagaacccggaccgtacgggtacccgttagttaacgtttcgtcggacggtacggaagaacggtaacgttaaaaggttggacggttaaggtacgggtcgggggacacgagtcgaacgtaacccggg

SEQ ID NO: 440506 - DNA, 734 bp, Homo sapiens
  misc_feature: GZ8MTXP01A6EWE.10.88.H11.1.454.CMB.2.raw
  modified_base (403)..(403): a, c, t, g, unknown or other
  modified_base (525)..(525): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgccgtggggcctgagtgaagatctcctggcgaggtcttctaggttaccacctttaacacctagtcggctatctccgtgggtcgcggacacggcccctggaaccaaagggtcttggagggtcgggggtggggggtcggtaccaggtcctacgtttaaccgaaggtttgggaccttaaacgaactaaaagtttacgnggaccaacgtaaggtaaacgttcccgaagggaccaaagggagttacccaactacgtacggaaaaccccaacgtaacgaaacccaacactacccgaacgacgacctaacgaccgacccttaanaagtacggaaacctgggggaacgggtaacgccgtagaggtaactcgacggaaccggaacgtaccgggtaccgttaatttagtttaacccggtcggaccggaacgggaaacggtaaacgggttaaaacggttaaacggttcgggttaacgggttaaggggttaccgggtaaccggggaaactacgttacgtaacggaaccggtaaccggg

SEQ ID NO: 440507 - DNA, 785 bp, Homo sapiens
  misc_feature: GZ8MTXP01EEUSB.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggagggtgaagacgcccgtggggcctcgagtagaagactcctccgtggcggacgggtctttcgttacggtttaacctaaccctttaacaccttagtcggctactcctccgtggggtcaccgacgaccggcccctagggaacaaaggtacgttggagggttgggggtgggggtcgggtcaggtcccgttacgttaaccgaaggtttcggacctaactaaactaaaatttcgacgacaacgtaaggtaaaccgttaccgaagggtaaccagggtaactacccaaccgtaagtacgaaaccccaacgtaacgaaccaccgtaactacccgaacggaacaccaacgacgacctaaactaggaacggaaccgtaggggaacggacggtaccaggtacgacttacgacggaaaccgaccggtaaccgggtaccttaaagttcgtttaacgtcggaccgggtaacggaaagggaaaccggtaaaagggttaaacgggttacggttaaacccgggggttaagggttaaccgggggttaaccccggggggtaaactaaccggttaacggtaaccggttaaccgggtaacccgggg

SEQ ID NO: 440508 - DNA, 766 bp, Homo sapiens
  misc_feature: GZ8MTXP01C2XFC.10.88.H11.1.454.CMB.2.raw
  modified_base (657)..(657): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtggggcctcgagtagaagatcctccgtgcggaggtcttcgttacggtttaacctaacccttttaaacacccttagtcggtactacgtccgtccgtggggtcgaccgaaccgaccgggtccccccgtagggaaccgaaagggtccgtttagggaggggttggggggtaggggggttgggtacgacggtccgttaccgttaaccgtaaggtttcggaccttaaacgaaaccttaaaagttttacgacggaaccaaacgtaaggtaaaaaccgtttcccgaagggaacctaagggaaacgttacccaaccgtaagacgaaacccaacaacgaaccaacaactacccgaacggaacaccaaaccaacctaacagtacgaacgtaggaagggacgtaccgtagagacttcgacgacgaaccgtacggtaccgttattacgtttcgnggccggacggtaaggaaacggtaaacggttaaaggttacgggttacgggttacgggtaacgggtaccgggggaactacggagttaccggaaccgcccgggtaaccgggg

SEQ ID NO: 440509 - DNA, 670 bp, Homo sapiens
  misc_feature: GZ8MTXP01CKHCV.10.88.H11.1.454.CMB.2.raw
  modified_base (266)..(266): a, c, t, g, unknown or other
  modified_base (463)..(463): a, c, t, g, unknown or other
  modified_base (578)..(578): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcattccttttcttggtggcagcagcaacaggtgcccactcccaggttcagctggtgcagtcgtggggctgaggtgaagacgccgtgggcctcagtgaagatctccgtgcgaggtcttcgtgttaccacctttaacnctagtgcatctccgtggtcgcgacgaccggccctacggagaaggtcttggaggttgggggtgggggttagggtccgaggtccgtccgtttaaccgtaaggtttggacttaacgaaacctaaactttagtgacccaaacgtaagaacgttccgaaggaacgaagacgtaccaacgatacgaccaacgacaacacaacncccgaacgacgactaaccgaacacccgaacacgtacggaaaccgggtagaacgggaccgtaccgagagtactacgtacggaaccgacgtacccggtaccgttagtaacttttcgnggtaccgacggaaagtaaggttaaccggttaaaggttaggtaacgggtacggtaacgggttacgggggacttacgtaacgcggtaacccggg

SEQ ID NO: 440510 - DNA, 725 bp, Homo sapiens
  misc_feature: GZ8MTXP01A84IU.10.88.H11.1.454.CMB.2.raw
  modified_base (209)..(209): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagngccgtggggcctcagtgaagatctcctgcgaggtcttctggttacctacctttaacacctatcggctacgtctccgtgggtcgcgacgaccggcccctaggaacaacgggtcttggagggttgggggtgggggtgggtcaggccgtactttaaccgaaggtttcggactaacgaaactaaattactggaccaacgaaggtaaacgttacccgaaggaactaaggtacgtacccaaccgtagtacgaaacccacgaacgaaccaacgtactacccgaacggaacgaccaacgaccgaccctaacgtaacgtacgggaaaccgttagggggaacggggtacgaccgtaggaagtacgtcgtacggaaccgaccgtaccggtaccgttaacttacgtttcgtacggccgggtacggaaacggtaaacggtaacggttaaaacgggttcggaacgggtttaacggggtacggggttaacccgggggaacaccggttagtccgggaaccgtaacccggggg

SEQ ID NO: 440511 - DNA, 688 bp, Homo sapiens
  misc_feature: GZ8MTXP01CFT1V.10.88.H11.1.454.CMB.2.raw
  modified_base (437)..(437): a, c, t, g, unknown or other
  modified_base (443)..(443): a, c, t, g, unknown or other
  modified_base (446)..(446): a, c, t, g, unknown or other
  modified_base (453)..(453): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctcgtgcgaggtcttcgtaggttacctacctttaacacctagtggcatctccgtgggtgcgacgcggcccctggaacaaggtacttggaggtgggggtgggtgggtcgaggtcgtacgttacgaggttgactacgaactaaattagtgacaacgtaagaaacgttacccgaaggaccagtacgtacacccgatacgacccanagacanacnccgagancaactagctaacagttacggaactggggaacggtacggtacctagggaaactcgttcccgaagggacccgtaaaccgtaccgggggttacccttaaaggttctttccggagcccgggtaaaggaaacggtaaacggtaaaccgggttaaaaagttcggaacccggggttaaggggtaaccgggttaacccggggggaactacgggaacgttaacgggaacccgtaacccgggggg

SEQ ID NO: 440512 - DNA, 710 bp, Homo sapiens
  misc_feature: GZ8MTXP01AJKII.10.88.H11.1.454.CMB.2.raw
  modified_base (592)..(592): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctcctgcgaggtcttcgtggttacctacctttaacaccttagtggcactctccgtgggtgccgacgacggcccctagggacaaagggtctttgggaggttgggggtagggggttcgggtacaggccgtccgtttaaccgaaggtttcggacttaacgaactaaaagtttgagaccaacgtaaggtaaacgttaccccgaagggaacagggactccaaccatcgaaccacaagacacacgtaccgacgacgacaacgtacacctaaccgaagtacgggaacgtagggggacggacgtacccgtaggaacgtacgtcgtacggaaccggaccgtaccgggtaccgttacttacgtttcncggacggacggaaggaacggtaaaacggttaaacgggttcggttacggggttaacggggttaacggggttaaccggggggaaccctacggacgttaaccgaacccggtaacccggggg

SEQ ID NO: 440513 - DNA, 690 bp, Homo sapiens
  misc_feature: GZ8MTXP01DOVVI.10.88.H11.1.454.CMB.2.raw
  modified_base (616)..(616): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctcctgcgaggtcttctaggttacctacctttaacaccttagtcggctatccgtcgtgggtcgaccgacgacggcccctaggaacgaaggtcgttggagggttgggggtgggttggtcgacggtccgtacgttaaccgtaaggttcggaacctaacgaacttaaaatttacgtcgaaccctaacgtaaacggttaaaaccggttacccgaaggggtaccaaagggtaacgttacccgaaaccctagtacggaaacccaacgaacgaactaacgactacccgaacggacaccaacgaccgaccttaacgagtacggaaacgtagggggacggagtccgtagactacgtacgacgaccgacgtaccgttacgttatttacttcgnggcgacggagtaaggtaacgttaaaggttcggttacggtaaggtacggtcgggatacgagtccgcgtaaccggg

SEQ ID NO: 440514 - DNA, 650 bp, Homo sapiens
  misc_feature: GZ8MTXP01EAE3G.10.88.H11.1.454.CMB.2.raw
  modified_base (367)..(367): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcagtgaagatctcctgcgagtcttgtcggttacctacctttaacactatggctatctcgtggtgcgacgcggccctggacaaggtcgttggagggtggggtggggtggcaggcgtactacgagttcgactaacgactaattngacaanaagtaaacgttcgaaggacagtacgtacaccatacgaaccacagacacactaccgacgacgacaacacgacctaacagtacgaacgtaggggaacggtacgaccgtaggaacgtacgtcgtaacggaaccgaccgtaccggtacgttacttacgttcgtcggacggacggaaggaaacggtaaacgggttaaaacggttcggggttaacgggttaaggggttaaccggggttaaccgggggtaactacggacggtaaccggaaccggtaacccgggg

SEQ ID NO: 440515 - DNA, 685 bp, Homo sapiens
  misc_feature: GZ8MTXP01B1HQM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgaggtcttctggttacctacctttaacacctatggcatctccgtgggtcgcgacgacggcccctggacaaggtacgttggaggttgggggtgggggtgggtcaggccgtactttaaccgaaggttcggacctaacgaactaaatttatagaccaacgaaggtaaaacgttcccgaaggacaggagtccaaccagtcgaacccacacgacacactaccacgacgaccacacgaccctaacacgtaggaaccgtaggggaacggacgtaccgtaggaagtacgtcgtacggaaccggaccgtaccgggtaccgttaacgttcgtttccgtcggaccggacggaaggtaaacgggtaaacggttaaaacgggttcgggttaacgggttaaggggttacgggttaacccggggggactacggacgtaacggttaaccggtaacccgggg

SEQ ID NO: 440516 - DNA, 704 bp, Homo sapiens
  misc_feature: GZ8MTXP01BB0LM.10.88.H11.1.454.CMB.2.raw
  modified_base (678)..(678): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcagtgaagatcctctgcgaggtctttcgtggttacctacctttaacaccttagtggctactccttccgtggggtcgaccggaccgacgggtcccccctaggaaccgtaaaggtaccgtttggaggggttgggggtgggggtgggtaccgaggtccggtaccgtttaaccgaaggtttcggacctaaacgaactaaaacgtttatcggaccaacgtaacggtaaaacgttcccgaaggtaccaagggtaacgtcccaacagtacgaacccaacaacgaccacactaccaacgacgacaacacgacctacaacgtaggaaccgtaggggaacgggacggaccgtagaagtactcgacggacgaccgtacggtaccgtagttacttcgtgaccggacgttaaggaacgggtaaacgttaaacggttcggttaacggtgggttacgggtaaccggggganacggttacgtaacgccgtaaccgggg

SEQ ID NO: 440517 - DNA, 675 bp, Homo sapiens
  misc_feature: GZ8MTXP01CKKVR.10.88.H11.1.454.CMB.2.raw
  modified_base (393)..(393): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcatcctttttcttggtggcagcagcaacaggtgcccactcccaggttcagctggtgcagtcgtggggctggaggtgaagacgcccgtggggcctcgagtgaagatctcctgcgaggtcttctggttactacctttaacacctatggcatcctccgtgggtcgaccgacgacggcccctaggaacaaagggtactttggagggttgggggtgggggtgggtcgaggcgtacttaaccgaagtttcggacttacaacgtaaatttgngacaacaaggtaaacgttcccaaggacaagacgtaccacaagtacgaacccaacaacgaacaacactaccgaacgacgacaacacgacctaacaagtaggaacgtaggggaacgggacgccgtaggaacgtactcgtacggaaccggaccgtaccggtaccgttaagttacgtttaacgtggaccggacggaaagaaacgggtaacggttaaaaggttcggttaacgggttaagggtacgggttaaccgggggaacacgacgtaacggaaccgtaaccgggg

SEQ ID NO: 440518 - DNA, 760 bp, Homo sapiens
  misc_feature: GZ8MTXP01CY8TU.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtggggcctcagtgaagatctctgcgaggtcttcgtaggttactacctttaacacctagtcggcatctccgtgggtcgcgacgacggcccctaggaacaaggtcttggaggtgggggtggggtggtcaggcgtacgttaaccgaagttcggactaacgaactaaaagtttatacggacctaaaccgtaaggtaaaaccgtttacccgaagggaacaacgggtaacggttacccaaacctaagtaccggaaacccaaacgaacgaacaactacacccgaacgaagaccaaacacggaccttaacaagtacggaaaccgtagggggaaacgggacggtacctaggaacgtaacgttaccgtacggaaacccggaacgtaacccgggggtacccttaagttaacgttttccggacggttaccgggaccggaaaggtaaacggtaaacgggttaaaaaacgggttgggttaaacggggttaaggggttaaaccggggttccggggggaacctacggttaacggttaaccggaacccggtaacccggggg

SEQ ID NO: 440519 - DNA, 697 bp, Homo sapiens
  misc_feature: GZ8MTXP01BH2QH.10.88.H11.1.454.CMB.2.raw
  modified_base (379)..(379): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctctgcgaggcttctggttacctacctttaacacctagtggcatctccgtggggtgccgacgacggcccctaggacaaggtacttggagggtgggggtgggggtgggtcaggcgtacttaccgaagtttcggactacgactaaattangacacacggaaacgttcccgaaggacagtacgtaccaccagtacgaacccacacgacacactacccgaacgacgacaacacgaccttaacagtagggaacctagggggaacgggacggtccgtaggaaggtactcgtacggaaaccggaccgtaccggggttaccgttaagtttaacgtttcgtacggaccggacgggaaaggtaaacgggtaaaacggttaaaacgggttcgggttaacggggttaacggggttacggggtttaacccggggggaacgtaccggttacggtaacggttaacccggtaaccccggggg

SEQ ID NO: 440520 - DNA, 796 bp, Homo sapiens
  misc_feature: GZ8MTXP01EYY9T.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagacgccgtggggcctcgagtgaagatctccgtgcgaggtcttcgtggttaacctacctttaacacctagtcggactactccgtcccggtgggtcgaccgaaccgaccggtcccccgtaggaaaccaaagggtaccgtttgggaagggggttcggggggttgggggtacgggttaccgagggtcccgttaaccgtttaaccggtaaaggtttcgggacccttaaaacgaaaccgttaaaaacgtttagtacggaaccgaaacgtaaacgggttaaaaaccgtttacccgggaacggaaacccgaaagggtaccgtacccgaaacctaagtaccgggaaacccaacgaaacgaaccgaaccaacgtacccgaacggacgaaccaacgaacgtaccaacgaagtaacgaacgacggggacgacggacctaggaacgttagccgtaaggaaccgtaccgtacggtaccgttaattacgttcgtacgaccggacggttaaagaacgggtaaaacggttaaaggttcggttaacgggtaacgggttaccgggttaacgggggacctaggaccgtaacggttaaccggaacccggg

SEQ ID NO: 440521 - DNA, 665 bp, Homo sapiens
  misc_feature: GZ8MTXP01BEPV9.10.88.H11.1.454.CMB.2.raw
  modified_base (490)..(490): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggtcttctggttaccacctttaacacctatggctatctccgtgggtcgcgacgacggccccgtaggacgaaggtcgttggagggtgggggtgggggtggtcgaggccgtacttaaccgaggtttcggactaacgaactaaagttgtacgacaacgaacggtaaaacgttacccgaaggacaaggtacgtaccaaccgagtacgaaaccacaacgaaccacactaccaacgacgacacgacgacctanagtacggaacgtaggggaaggcgtaccgtagagtacgtcgtaggaccgacgtaccgggtacgttagttacgtttcgcggttacgacggaaggaacggtaaacggttaaaggttcggttacggttaagggtacgggttccgggggaacacggttacgtaacgaaccgtaaccgggg

SEQ ID NO: 440522 - DNA, 734 bp, Homo sapiens
  misc_feature: GZ8MTXP01CS6RX.10.88.H11.1.454.CMB.2.raw
  modified_base (465)..(465): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtgggctggaggtgaagacgcccgtgggcctcagtgaagatctccgtgcgtaggtcttcgtacggttaacctacctttaacacctagtcggctactcgtcgtgggtcgacgacgaccggccccgtaggaacgaaggtcgttaggagggtgggggtgggggtggtcgaggtccgtacttaaccgtagttcggactaacgaactaaatttagcgacaacgaaggtaaaaccgttacgaaggtacaaggtaacgtccaaacctagtacgaaacccanacgaacactacgtaccaacgacgacaaccgacgacctaacgagtaacggaacgttaggggaacggacgtaccgtaggaacgtacgtaccgtacggaaacccgtaccggtaacccggtaccgtttaacgtttacgtttccggtacggacgggaaccggaagggtaaacggtaaaccggttaaaagggttccgggttaacgggttaaggggttaacccgggttaaccgggggaaccaacggttacgtaaccggaaccggtaaccccggggg

SEQ ID NO: 440523 - DNA, 698 bp, Homo sapiens
  misc_feature: GZ8MTXP01DCYNQ.10.88.H11.1.454.CMB.2.raw
  modified_base (602)..(602): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcgagtgaagatcctccgtgcgaggtcttcgtaggttacctacctttaacacctagtcggcatcctccgtgggtcacgtacgaccggccccgtaggacaaggtcgttggaggtgggggtgggggtggcaggtccgtcgtaaccgtagttcggactaacaactaaaatttgtacgacaacgtaaggtaaaaccgttaccgaagggtaccaagggtaacgtaccaaacccagtacgaaacccaacaacgaaccaacaacgtacccaacggaacgaccaaacgacgtacccctaaagagtaacgggaaacctagggggaaacggacgtaccgtaggaagtacttacgacggaaccgacgtaccggtacgttatttcttcggngcgtaacgaaggtaacgaaacggttaaagttcggttaacgggttcgggtaaacgggttcccgggggaataccgagtaacggaacccgtaaccgggg

SEQ ID NO: 440524 - DNA, 655 bp, Homo sapiens
  misc_feature: GZ8MTXP01A2ZKZ.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtagcccactcccaggttcagctggtgcagtctggggctggaggtgaagagcccgtgggggcctcagtgaagatctcctgcgaggtcttctggttaccacctttaacacctatggcatctccgtgggtgcgacacggcccctggacaaggacttgagtggggtggggtgggtcagcgcttaccgaagttggactaacgactaaattacngacaacgagtaaacgtccgaaggacagactaccaacctatcgaaaccacacgaacacacaccgacgacgacacacgacctacagtagaacgtacggggaggacgccgtaggacgtacgtacgtacgaaccgaaccgtaccggtaccgttaacttacgttaacgtacggacggacggaaacggtaaacgggtaaacggttaaaacgggttcgggttaacgggttaacggggttaacggggtaacccgggggtaactaccggttacgtaaccggaaccggtaaccgggg

SEQ ID NO: 440525 - DNA, 661 bp, Homo sapiens
  misc_feature: GZ8MTXP01CPRWI.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttaccacctttaacacctatggcatcgtccgtgggtcgcgtaacgacgggccccctaggaaccaaagggtaccgtttggaagggttcggggggttggggggttgggggtaccgtaggtttcggaccgttttaaccgaaaggttttgggaccttaacgaactaaaaactttataggacaaacgtaaggtaaaacgtttcccaaggggaccaaggtacggtacacccgatcgaacccaacagacaacactaccacgagacacacgacctaacataggaacgtagggacggagaccgtagagacgtcgtacgacgacgacgggtaccgtagttaactttctgcgacggagaaggtaacgttaaagttgttacggtaaggtacgttccgggggaacacgagtcgaacgtaaccggg

SEQ ID NO: 440526 - DNA, 710 bp, Homo sapiens
  misc_feature: GZ8MTXP01B0QUX.10.88.H11.1.454.CMB.2.raw
  modified_base (490)..(490): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtcgcccactcccaggttcagctggtgcagtcgtgggctgaggtgaagacgcccgtggggcctgagtgaagactctccgtgcgaggtcttcgttggttaacctaaccgttaacacctagtcggctatcgtccgtggggtcgacgacgacggccccgtaggaaccgtaaagggtcgttagggaggggttgggggtgggggtcggtacgacggccgtacgtttaaccggtaaggtttcggaccttaaacgaaacgttaaaagtttcgtacgaacgtaacgaagtaaaccgttacaaggggtaacaggtacgtaccaactagacgaacccgaanacgaccaacacaccgaacgacgacaacgactaccacaacgtaggtaaacgcggggaacggacgtaccgtagaacggtacttacggacggtaaccgaccgtacggggtaccttaatttcgttcgtagacggacggaaacgaaggtaaacggttaaggttcggttacgggttaagggtcgggttaaccggggaacacgttacgtaacgaacgtaacccgggg

SEQ ID NO: 440527 - DNA, 725 bp, Homo sapiens
  misc_feature: GZ8MTXP01DX6U1.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccacctcccaggttcagctggtgcagtcgtgggggctggagggtggaagagccccgtgggggcctcgagtgaagatctccgtgcgaggtcttcgtggttacctaccttaacacctagtggcatctcgtggtgcgacgacggcccctaggacaaggacgttggaggtgggggtggggtgggtcaggtccgtacttaaccgaaggtttcggactaacgtaaacgtaaaatttagtaggacctaaccgaaggtaaaaacgtttacccgaagggggtaaccctaaaggaacggttacccaaacccgtaagtacgggaacccaacgaacgaacaacaactaccgaacgaacgaccaacacgaccctaacgaagtacgggtaaacgtagggggaacgggtaacggacccgttaggaaagtactcgtacggaaaccgacgtaccgggtaccgttacgttaattcgtcggacggacgaaaggtaacggtaaaacggttaaaacggttggttaaccgggttgggttaacgggtaaccgggggacaacgagtaacggaaccgtaaccgggg

SEQ ID NO: 440528 - DNA, 633 bp, Homo sapiens
  misc_feature: GZ8MTXP01EV9DW.10.88.H11.1.454.CMB.2.raw
  modified_base (457)..(457): a, c, t, g, unknown or other
  modified_base (553)..(553): a, c, t, g, unknown or other
  modified_base (617)..(617): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctccgtgcgaggtcttcgtggttaccacctttaacacctatggctatctccgtgggtgcgacgacggccccctgggacaaaggcttaggaggtgggggtgggggtgggtcaggccgtactttaaccgaaggtttggacctaaacaactaaaatttgtaggaccaacgaagtaaaacgtttcccgaaggggtaacaaggtacgtaccaaccgatacgaacccaacgaanacacaactaccgacgaacgcaacacgacctaacagtaggaaactggggaggacgccgtagagtatcgtcgacgacgtacgggacctataatttcgngcggacgagtaacggaacgttaaaaggttcggttacggtaagggtacggttaacccgggggaanacgagtcgaacgtcgg

SEQ ID NO: 440529 - DNA, 743 bp, Homo sapiens
  misc_feature: GZ8MTXP01AULXM.10.88.H11.1.454.CMB.2.raw
  modified_base (277)..(277): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtgggcctcgagtagaagatcctccgtgcgaggtcttcgtggttacctacctttaacacctanggcatcgtcccgtgggtcgacgacgacggcccccgtggaacaaggtcgttggagggtggggtgggggtggtcaggtccgtacgttaaccgaaggtttcggaccgtaacaacgtaaatttacgtaggacgaacgaaggtaaacggttacccgaagggaaccaagggtacgtaccaacctagtacgaacccaacgagaaccaactactacccgaagacgaccaaccgacgaccctaacgaagtacgggaaccgttagggggaaacggaccgtaccgtagggaacgtaccgttaccggtaacggaaccggaaccggtaacccggggttacctttaacgtttacgtttccggtcggacgggtaccgggaaagaaacggggtaaacgttaaaaggggttcggttaacgggttaacggggtacgggttaacccgggggataccggacgttaacggaacccgtaacccggggg

SEQ ID NO: 440530 - DNA, 677 bp, Homo sapiens
  misc_feature: GZ8MTXP01CON4P.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtgggggcctcgagtgaagatctcctgcgaggtcttctggttactacctttaacacctatggcatctccgtgggtgcgacgacggccccctggacaagggtacttggaggtgggggtgggggtgggtcgaggcgtcttaccgaaggttcggactacaactaaacttatgacacagtaaacgttcccaaggacaggacgtacaccatcgacccacagacacgactaccacgacgaccacgacgaccttacagtacggaacgtaggggacggacgccgtaggagactcgtacggaccgacgtaccgggtaccgttacttacgtttcgtcggccggtacgggaaacggtaaacgggtaaacggttaaaacgggttacgggttaccgggtttaacgggggttaaccggggttaacccggggggggaacctaacggttaacggtccgggaacccgtaaccccggggg

SEQ ID NO: 440531 - DNA, 766 bp, Homo sapiens
  misc_feature: GZ8MTXP01BA95O.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctggaggtgaagcgccgtggggcctcgagtgaagatctcgtgcgaggtctttcgtaggtttaacctaccttttaacaccgttagtggactactccgtccgtgggtgacgacgtacggccccgtaggacaaaggtcttggacggttgggggtcgggggtggtcacggtcgtaccgtttaacccgaaggtttcggaccttaaacgaacttaaaattcgtaggacaacgtaacggtaaaaacgttcccgaaggggaccaaggtacggtaccaacctaagtcgaaaccacgaacgaacactaacacccgacgaacgacacacgacctacagttaggaaccgtaggggaacggacgtaccgtaggaacgtacgtcgttacggaaccggtaaccgtaaccggggtaccgtttaacgtttaccgtttaacgttacggaccgggtaaccgttaagggtaaacggtaaacgggttaaaaacgggttcgggttaaacggggttaacggggtttaacggggttaacccgggggggtaacaaccggttacggtaacccggttaaccggttaaccccggggg

SEQ ID NO: 440532 - DNA, 698 bp, Homo sapiens
  misc_feature: GZ8MTXP01BEO1Q.10.88.H11.1.454.CMB.2.raw
  modified_base (391)..(391): a, c, t, g, unknown or other
  modified_base (452)..(452): a, c, t, g, unknown or other
  modified_base (507)..(507): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtgggggcctcgagtgaagatctccgtgcggtaggtctttcgtcggttaactaccttaacacctagtggctatcctcgtgggtcgcgacgacggccccgtaggaccaaaggtcttggaggtgggggtgggggtggtcaggcgtcttaaccgagttcggactacgaactaaattcngtacaacgagtaaacgttaccgaagggactaaggacgtcaacctagtcgaaacccacgaanaccaacactaccgaacgaacgacaaaccgacgacctaacgacgtaaggtaaccgnggggaaaggtcggacctaggaagtacgtcgtaacggaaccgaaccgtaccgggtacgtttaaacttcggttcgtacgcgggtaacgaaaggtaacggtaaaacgggttaaaaggcggggttaaaacgggtgggggttaaccgggttaacccgggggaactacggaacggttcggaaacccggtaaccgggg

SEQ ID NO: 440533 - DNA, 702 bp, Homo sapiens
  misc_feature: GZ8MTXP01A7XD3.10.88.H11.1.454.CMB.2.raw
  modified_base (291)..(291): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtcgtggggctggaggtgaagacgccgtggggcctcgagtgaagtactctcctgcgaggtcttcgtggttacctaccttaacacctagtcggcatctcgtgggtncgacgcgcccgtagacgaagtcgtggaggtgggggtgggtggcagtccgtactacgagttcgactaacaactaaacttatagacaacaggtaaaacgttacccgaaggaaccaagaaccgtaccaacgaagtacgaaacccaacgaacgaaccaacaactacccgaagaacgaaccacaaccgacctaacgagtaacgggaacgtacgggggaacggacggtaccgaggaagtaacgttacgacggaaaccgtacgtaacccgggtacccgtttaatttacgtttccggtacggccggaacggaaaggtaaacgtaaaacgggttaaaacgttacgggttacggtttaacggggtacgggtttaacccgggggaacaacggttaacgttaacggaaccggttaacccgggg

SEQ ID NO: 440534 - DNA, 703 bp, Homo sapiens
  misc_feature: GZ8MTXP01A8U70.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacgaggtgcccactcccaggttcagctggtgcagtcgtggggctgaggtgaagacgcccgtggggcctcagtgaagatctcctgcgaggtcttctaggttacctaacctttaacaccgtatggctatccgtccgtgggtgccgacgcggcccctaggacaagggtcttggaggttgggggtggggtggtcaggcgtacgtttaccgaaggttggacttaacaactaaattacgtgacacgagtaaacgttcccgaaggacaggacgtcaaccagtacgaaacccacaacgacaacactaccgacgacggacacacgaccgtaacgagttacggaacgtggggaacggacgtaccgtacgggaatcgacgttaccggaaccggtaaccggaccggtaccgttaacgtttacgtttaaccgttaggccgggtaacggaggaaacggtaaacggttaaaacgggttcgggttaccgggttaacggggttaaccgggttaacccggggggtaacctaccggaacgtaaccggttaacccggtaacccggggg

SEQ ID NO: 440535 - DNA, 669 bp, Homo sapiens
  misc_feature: GZ8MTXP01BWCYS.10.88.H11.1.454.CMB.2.raw
  modified_base (213)..(213): a, c, t, g, unknown or other
  modified_base (234)..(234): a, c, t, g, unknown or other
  modified_base (379)..(379): a, c, t, g, unknown or other
  modified_base (427)..(427): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggagggtgaagngccgtggggcctgagtgaagntctcctgcgaggtctttcgtggttacctaacctttaacacctatggctatctcgtgggtcgcgacgacggccccgtggacaaggtcgttggaggtgggggtggggtggtcaggcgtcttacgaggttcgactacaacgtaaattntacgacaacgtagtaaaacgttccgaaggacagacgtaccaaccgtanacgaaccacaacgaaccacacgtaccgacgacgacaaccgacgacctacgtaagtaggaaacgtacggggaagggacgtaccgtaggacgtagtcgacggaaccgacgtaccggtacccgttagttcgtttcgtcggacggacggaaggtaaacggtaaacggttaaaagggttcggttaacgggttaagggttacggggtaaccgggggtacaacggacgtaacggaaccgtaacccgggg

SEQ ID NO: 440536 - DNA, 705 bp, Homo sapiens
  misc_feature: GZ8MTXP01AD8TK.10.88.H11.1.454.CMB.2.raw
  modified_base (388)..(388): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcagtgaagatctcctgcgaggtcttcgtggttacctacctttaacacctatggcatctccgtgggtgccgacacggccccgtaggaacaagggcttggaggtgggggtggggtggtcagccgtactttaccgaagttcggactaacgaactaaattactgacctanaaggtaaaacgttcccgaagggtaccaagggacgttacccgaccaagtcgaaaccccaacgaacgacacaacgtaccaacgacgacaacacgaccctacgaagtacggaaacgtggggaacggacgaccgtagacgtacgtcgtacggtaccggaaccgtacccgggtaccgttaacttacgttttccgtggaccggtacggaacggtaaacggtaaaacgggttaaaacgggttcgttaacgggggtttaacgggtaacggggtttaaccggggggaacctaacggttacgtaaccggaaccggtaaccccggggg

SEQ ID NO: 440537 - DNA, 707 bp, Homo sapiens
  misc_feature: GZ8MTXP01CSKT7.10.88.H11.1.454.CMB.2.raw
tcagcatagtagtgcacgaccggtgctcgatttagcgacagcgagaacacacaaaggggacccaaaaaccacacccctccttgggagaatcccctagatcacagcctcctcaccatggactggacctggagcatcctttttcttggtggcagcagcaacaggtgcccactcccaggttcagctggtgcagtcgtggggctgaggtgaagacgccgtggggcctcgagtgaagatctccgtgcgtaggtcttctaggttacctacctttaacacctatcggctatctccgtggtcgacgacgacggcccctaggacgaaaggtacttggaggtgggggttgggggtgggtacgaggtccgtacgttaaccgaaggtttcggactacgaactaaattagtgactaacgagtaaacgttacaaggtacagagtacaaccatacgaacacgaacaacaacactccaacgagacacacgcctaacgagtacggaaacgtacgggaaggacgaccgtgaacggtactacgtacggaaaccgacgtacccggtacccggttaattacgtttcgttacggacggaccggaaaggtaaacgggtaaaaccgttaaaaaggggttcggttaacccggggttaagggtttaaacccgggggtttaaccggggggaaaccacggttaaccggttaacgggaacccgttaaccccggggg

SEQ ID NO: 440538 - DNA, 674 bp, Homo sapiens
  misc_feature: GZ8MTXP01D5A2V.10.88.H11.1.454.CMB.2.raw
  modified_base (380)..(380): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagccctggggcctcagtgaagatctcctgcgaggtcttgtggttaccaccttaacacctagtggcatccgtccgtgggtcgcgaccgacggcccctaggaacaaggtcttggaggtgggggtgggggtggtcgaggccgtacttaaccgaggttcgactacgaactaaattnagacaacgagtaaacgttcaaggacaagacgtacaccagtcgaaccacaacgacaacactaccgaacgacgacacacgcctaacagtacggaacgtggggacggagtacccgtaggacgtaacgtcgtaacggaaccggaacgtaaccgggtacgtttaacgttacgtttcgtacggccgggtaacggaaagggtaaacggtaaacggttaaaacgggttgggttaaacgggttggggttaacgggttaaccgggggaactaacgttacggttaacggaaccggtaacccgggg

SEQ ID NO: 440539 - DNA, 828 bp, Homo sapiens
  misc_feature: GZ8MTXP01B0URU.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctgagtgaagtatcctccgtgcgaggtcttctggttacctaaccttaacacctagtggcatcgtccgtgggtgccgaccgacggcccccgtaggaaccgaaggtacgttggaggggttgggggtagggggtggtacgacggccgtacgtttaaccgaggttcggactaacgaactaaattagtcgaccgtaaacgacggtaaaacgttcccgaagggaccaaggtaacgtaccaacccgtaagtaccggaaacccaacgaacgaaccaaccgaactacccgaacgaacggaccaacgaaccgtacctaaacgaacggttaggaaaccgtggggaaacggggtaccggtaccgtaggtaaccgtacgtcccgttaacgggaaacccgtaaccggtaacccgggggttaccccgtttaaattttaaaccggttttccggtacgggacccgggggttaaaccgaaagggggtaaacgggttaaaaccggggttaaaaacggggttacgggttaaccgggggttaacgggggtttaacccgggggtaaccggggggttaaacccgaacggttaccgggtaacccgggttaacccgggttaaccccgggggg

SEQ ID NO: 440540 - DNA, 716 bp, Homo sapiens
  misc_feature: GZ8MTXP01DY9LH.10.88.H11.1.454.CMB.2.raw
  modified_base (380)..(380): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgcccgtggggcctcagtgaagatctcctgcgaggtcttctggttacctacctttaacacctatggctatctccgtggggtcgacggaccacgggccccctggacaaaggactttggaggtgggggtgggggtggtcaggcgtacgttacgaaggttgactacaactaaattntgcacgagtaaacgttcaagggacaagacgtacacgatcgaccacaagaccacactacccgaacgaacggccaacgaacgtaccctaaacaacgttaacgggaaaccgttaggggggaaacggtacggacccgttaagggaacgtaacgtttaccgaacggtaaaccgaccggtaacccgggtaccggtttaacttacgtttaaccgtagggaccggtaacgggaaaggtaaacggtaaacgggttaaaaggttgggttaaaccgggtttaaggggttaaaccggggttaaccggggggtaacacgttacggttaacggaacccggtaacccgggg

SEQ ID NO: 440541 - DNA, 771 bp, Homo sapiens
  misc_feature: GZ8MTXP01BGRI0.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctccgtgcgaggtcttcgtcggttacctaacctttaacaccttagtcggctagtccgtccggtgggggtcgccggtaccgaccgggtcccccgtaggaaccgaaagggtcgttggaggggttggggggttgggggtgggtcgaggtcccgtacgtttaaccgaaaggtttcggaccttaaacaactaaaacgtttgtacggaccaacgaaggtaaaccgttcccgaaggggacctaagggtacgtaccaacccgtaataccgggaaacccaacgaacggaaccaacaacgtacccgaacgaacgaccaacgacgacctaacgaacgtacggtaacgtaggggaacggacgtcccgaggtaagtacgtccgtacggaaccgaccgtaaccgggtaccgttacgttacgttcggtacggcggacggttaacggaaacggtaaacggttaaaacggttcgggttaacgggttaacgggttaaccggggttaacccggggggaactaccggttacggtaaccggaacccggtaacccgggg

SEQ ID NO: 440542 - DNA, 697 bp, Homo sapiens
  misc_feature: GZ8MTXP01BZ7J9.10.88.H11.1.454.CMB.2.raw
  modified_base (387)..(387): a, c, t, g, unknown or other
  modified_base (397)..(397): a, c, t, g, unknown or other
  modified_base (402)..(402): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtggggctggaggtgaaggacgcccgtggggcctcgaggtgaagtactcctccgtgcgtaggtcctttctcggttaacctaaccttaacacctagtggcatcctccgtgggtcgacgacgacggccccgtaggacaagggtacttggagggttgggggtggggttcggtcgaggtccgtacttacgagttcggactanaactaaattntcganacaggtaaactccgaaggactaggaacgtccaaccagtacgaacccagaacaaccacacgtacccaaggacaccgaacacgaccttaacaagtacgggaaacctgggggaaacgtcgtaccgtagacgtacgttcgacgggaaacccgacgtaaccggggttaccttaagttcgtttccaggttcccgggaagttaaacggtaaacggtaacggttaaacggcggttaacgggtaaggggttaaccgggttaaccgggggaatacggacgtaacccgggaacgttaacccggggg

SEQ ID NO: 440543 - DNA, 708 bp, Homo sapiens
  misc_feature: GZ8MTXP01B2GCC.10.88.H11.1.454.CMB.2.raw
  modified_base (345)..(345): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacggcccgtggggcctcagtgaagatctcctgcgaggtcttctggttacctacctttaacacctagtggcatctcgtgggtgcgacgacggcccctggaacgaaggtcgttggaggttgggggtgggggttgggcnggccgtacttaaccgaaggtttcggaccttaaacaactaaaacgttgtcgaccgtaaacgaacggtaaaacgtttcccgaagggtacaacgggtacgtacccaaccgtatacgaaacccctaacgaacgaaccaacactacccgaacggaacgacaaccgacgaccctaacgacgtacggtaacgtaggggaacgggacgcccgtaggaacgtacgtcgtacggaaccgaccgtaccgggtaccttaagtttctttcgtcggcggtacggaaagtaacgggtaaaggttaaagggttcggttaccgggttaaggggtacgggttcccgggggacacggttacgtcggaaccggtaacccgggg

SEQ ID NO: 440544 - DNA, 641 bp, Homo sapiens
  misc_feature: GZ8MTXP01BPS6G.10.88.H11.1.454.CMB.2.raw
  modified_base (210)..(210): a, c, t, g, unknown or other
  modified_base (224)..(224): a, c, t, g, unknown or other
  modified_base (384)..(384): a, c, t, g, unknown or other
  modified_base (462)..(462): a, c, t, g, unknown or other
  modified_base (495)..(495): a, c, t, g, unknown or other
  modified_base (541)..(541): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagngccagtggggcctnagtgaagatctcctgcgaggtcttctcggttaccacctttaacacctagtcggcatcgtccgtgggtcgaccgacgacggcccctaggaactaagggtcttggaggtgggggtgggggtggtcagtcgtacttaccgaggttcgactaacaactaaattngacacgaaagtacgtccgaagggcagactaccacatacgaccacacgacacacacccacgacgactacgacgaccaanagtacggaacgtggacggacgtccgtagacgtntaccgtacggaaccgtaccgtaccggtaccgttattaacgtttcgnggtccggacggaacggtaacggttaaacggttaaacggttcggtaacgggttagggtaacgggttacccgggggacaacgtaacgttaacggtaacccgg

SEQ ID NO: 440545 - DNA, 720 bp, Homo sapiens
  misc_feature: GZ8MTXP01BWQDQ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcctggggcctcagtagaagatctctgcgaggtcttcgtaggttacctacctttaacacctatcggctactccgtccgtgggtgaccggacgtacgggccccctaggaccgaaaggtacgttggaggtgggggtgggggtggtcgaggcgtacttaaccgtaaggtttggactaacgaactaaagtttcaggtaacacgaaggtaaaacgttcccaaggggacaagtacgggtaccaaccgtaactcgaaacccgaacacgaacaacactacccgaacgaacgaccaacgaaccgtaccaacgaacggttaacggaaccgtaggggaagggaacgaccgttagggactacgtcgtacgaaccggaccgtacgggtacctttaagttacgttcgtacggttaccggacggttaaacgggaacggtaaacggttaaaacgggttcggttaaacggggttaagggtaccggggttcgggggaaactacgttaggtccgaaccggtaacccggggg

SEQ ID NO: 440546 - DNA, 685 bp, Homo sapiens
  misc_feature: GZ8MTXP01C24I2.10.88.H11.1.454.CMB.2.raw
  modified_base (270)..(270): a, c, t, g, unknown or other
  modified_base (479)..(479): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctccgtgcgaggtcttctggttactacctttaacncctagtggactatcgtccgtgggtcgacgaccgacggccccctaggaaccaaagggtcttggaggtgggggtgggggtggtcaggccgtcgttaaccgaggttcggactacaactaaaatttgtacgcaaccgaaggtaaaacgttacccgaagggacaaggtacgtaccaccatacgaacccacgagaacacactcccaagagaccanaccgacctacgacgtaacggaaccgtaggggaacggcgaccttaggaagtactcgtaggaacccgacgtaaccgggtaccttaagttcgtttaaccgcggccgaacggttaagaaacgggtaaacgttaaaagggttcggttaaacgggttaacgggttaacgggtaaccgggggaacacgttaacgtccggaacgtaacccgggg

SEQ ID NO: 440547 - DNA, 549 bp, Homo sapiens
  misc_feature: GZ8MTXP01BGBZ2.10.88.H11.1.454.CMB.2.raw
  modified_base (469)..(469): a, c, t, g, unknown or other
  modified_base (536)..(536): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacacctttaacacctatggcatcctctgggtgcgacacggcccctggacaaggtcttggaggtgggggtgggggtgggtcaggccgacttaccgaagtttcgggctacgaactaaattatgacacagaaacgttccgaaggacagagtcaccagtcgaaccacagacacatccacgagacacacgacctacagtagaacgtgggaggacgcctgacgntctgacgacgacggcctagtattctgcgcgagaagtacgttaaagttgacgtggtacgtcggggacnagtcgcgtaacgg

SEQ ID NO: 440548 - DNA, 698 bp, Homo sapiens
  misc_feature: GZ8MTXP01BUMIA.10.88.H11.1.454.CMB.2.raw
  modified_base (300)..(300): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattcctttttcttggtggcagcagcaacaggtcgcccactcccaggttcagctggtgcagtcgtggggctggaggtgaagacgcccgtggggcctcgagtagaagatcctccgtgcgaggtcttcgtacggttacctaacctttaacacctatcggcatcctcgtgggtncgacgacggccccgtaggacaaggtcgttggagggttgggggtgggggtggtcgaggccgtacttaccgtaaggttcgactaaacaacgtaaattagtcgacaacgtaaggtaaaacgttcccgaagggtacaaagggacgtaccaaccagtacgaaacccacaacgacaacactacccgaacgacgaccaacgacgtacctaacgacggtaacggtaaacggacggggtaaggacggtacccgtaggaacgtacgtcgtacggaaccgaaccgtaccgggtacccgttagttacgtttcgcggacggtacggaaggtaaacggtaacggttaaaagggttcggttacgggttaagggtacgggtccgggggaactacgacgtcgaacgtaacccggg

SEQ ID NO: 440549 - DNA, 683 bp, Homo sapiens
  misc_feature: GZ8MTXP01CQ3FS.10.88.H11.1.454.CMB.2.raw
  modified_base (242)..(242): a, c, t, g, unknown or other
  modified_base (266)..(266): a, c, t, g, unknown or other
  modified_base (291)..(291): a, c, t, g, unknown or other
  modified_base (439)..(439): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctctgcgnggtcttctggttactaccttaacncctagtggcatccgtccgtgggtcncgacgacggccccgtaggaacgaaggtcgttggagggtgggggtgggggtggtcgaggtccgtacgtttaaccgaggtttcggactaacaacgtaaaatttgtcgactaacaaggtaaaacgttccaaggacaaggtacgtaccaacntacgaccaacgagaccactacgtaccgaacgacgaccaacgtacgaccctaaagacgtacgaaacgtggggaacggtacgcgtacgagtaacttcgaggaaccgacgtacggtccgttaattcgttcgcggcgtacggagtaaacggtaaacggttaaacgggttggttaaccgggttaaggggttaacccgggttaaccgggggaactaacggttacgtaaccggaacccgggtaaccggggg

SEQ ID NO: 440550 - DNA, 621 bp, Homo sapiens
  misc_feature: GZ8MTXP01DITTK.10.88.H11.1.454.CMB.2.raw
  modified_base (370)..(370): a, c, t, g, unknown or other
  modified_base (375)..(375): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctccgtgcgaggtcttcgtggttaccacctttaacacctagtggcatctccgtgggtcgccgacgacggccccctaggacaaggtacttggaggtgggggtggggtggtcagcgtctacgagttggactacactaaattngacanaagtaaacgttccaaggacagagtaccaaccatacgaaccacaagacaacactaccaacgagaccacacgacctacgagtaggaacgtaggggaacggtacgccgtagaagacgtcgtacgaaccgacgtaccggtacgtacttgttcgtcggcggacggaaggtaaacggtaacgttaaaagggttggttaacgggttgggtacgggttaaccgggggacacgttacgtcgaaccgtaaccgggg

SEQ ID NO: 440551 - DNA, 805 bp, Homo sapiens
  misc_feature: GZ8MTXP01AOD6S.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgccgtggggcctcgagtgaagtactctccgtgcgaggtcttcgtggttacctaacctttaacacctagtggacatccgtcgtgggtcgaccgacgacggcccctagggacaagggtcttggagggttgggggtagggggtggtcgaggtccgtacgttaaccgaaaggtttcggacctaaacgtaactaaaacgtttagcgaacaaacgtaaacggtaaacgtttaccccggaagggaactaaggtacgtacccaaccgtaacgtacggaaaccccaacgaaacgaaccccaaacgtacctaccccgaaacggaaccggacctaaaccgaaccgtacccttaaccgaaaggtcgggtaaaaccggtagggggaacggacggtaccgtaggacgtacgtacgaacggaacccggaccgtaacccggtacgtttaacgtttacgttcgtcgggaccggtaacggttaaaggtaaaccgggttaaaacggttaaacgggttcggggttaacgggggtttaacgggggttaaccgggggttaacccgggggaactaaccggttacgggtaaccgggttaaccccgggtaacccggggg

SEQ ID NO: 440552 - DNA, 779 bp, Homo sapiens
  misc_feature: GZ8MTXP01CHJGA.10.88.H11.1.454.CMB.2.raw
  modified_base (223)..(223): a, c, t, g, unknown or other
  modified_base (231)..(231): a, c, t, g, unknown or other
  modified_base (236)..(236): a, c, t, g, unknown or other
  modified_base (261)..(261): a, c, t, g, unknown or other
  modified_base (266)..(266): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagcgccgtgggcctnagtgaagntctcngcgagtcttgtgtacctacttaacnctagngctatctcgtgggtcgcgacgcggccccgtaggacgaaggtcgtggagggttgggggtggggtgggtacacggtccgttaccgtaacgtaggtttcggaactaactaactaaattgacgaactaacgtaaggtaaaccgttacccgaaggaacgtaaggtaccgtaccaaccgtacgtaccgaaacccaacgaacgaccaactaccgtacccgaacgaacgaccaaacgaccggtaaccccttaagtaacggacgggtaaaccgtagggggaacggacgtcccgtaaggacgtaacgtcccgtaagggaaaccgtaccggtaacggttacccgtttagtttaactttccgggacggttacccggaaacgggttaaagggtaaacccgggttaaaagggttaaaaccgggggttgggttaaaccccgggggtttgggggttaaacccgggggttaacccgggggtaacctaacgggttaacggttccggggaaccccgggttaaccccgggggg

SEQ ID NO: 440553 - DNA, 662 bp, Homo sapiens
  misc_feature: GZ8MTXP01BS5BE.10.88.H11.1.454.CMB.2.raw
  modified_base (233)..(233): a, c, t, g, unknown or other
  modified_base (292)..(292): a, c, t, g, unknown or other
  modified_base (297)..(297): a, c, t, g, unknown or other
  modified_base (378)..(378): a, c, t, g, unknown or other
  modified_base (560)..(560): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagntctcctgcgaggtcttctggttacctaacctttaacacctatggctactctcgtgggtncgacncggcccctaggacaaggcttggaggttgggggtggggtcggtcaggcgtacttaaccgagttcggactaacgactaaattngacaacgaggtaaacgttccgaagggacagacgtaccaaccgtatacgaacccaacgacgaaccacgactccgaacgacgccaacgacgaccctaacacgtaggaacgtagggggaacggacgtacccgaggtagtacgttcgacggaacggaccgtaccggtaccgttagttacgtttcgnggacggacggttaaggtaaacggtaaacggttaaaggttcggttaagggttcgggttaggggttcccgggggactacggacgtaacggaacgtaacccgggg

SEQ ID NO: 440554 - DNA, 709 bp, Homo sapiens
  misc_feature: GZ8MTXP01DWGGV.10.88.H11.1.454.CMB.2.raw
  modified_base (683)..(683): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtcgtggggctggaggtgaagacgcccgtggggcctcgagtagaagactcctccgtgcgaggtcttcgttacggttaacctaacctttaacacctagtcggactacgtcctccgtggggtcgaccgacgaccgggcccctaggaacgaaaggtcgttggaaggggtcgggggtagggggtcggtacacggtccgttacgttaaccgtaggtttcggacctaacgaaaccttaaagttcgtacgacgtaacgaagtaaaccggttccaagggaactacggtaacgtaccaccgagtacgaaacccacgaacgaaccaacgactaccgaacgacgacaactacgaccctaagacgtacgaacgtaggggaacggtacgaccgtagacgtactacgaggaaccgcgtaacggtcgtttactagtttcgcgacggtacgaaggaaacggtaacgttaaagggttcggttaacgggttaacgggttacgggtccggggtanacggttacgtcgaaccggtaaccggg

SEQ ID NO: 440555 - DNA, 684 bp, Homo sapiens
  misc_feature: GZ8MTXP01EMPO3.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctcctgcgaggtcttctggttaccacctttaacacctatggcatctccgtgggtgacgacgacggccccctggacaaagggtcttggaggtgggggttgggggtgggtcaggccgtctttaaccgaaggtttcggactaacgaactaaattagtacgacaacgaagtaaacgttccgaaggacagacgtcaaccgatacgaaacccacagacacactaccaacgaacgacaacacgacctaacgacgtacgaacgtggggaagggacgtcccgtagaacgtacgtacgtacgaaccgaccgaccggtaccgtaacttacgtttccgtgggttacggaccggaaaggtaaacggtaaacgggttaaaagggttcggttaacgggttaacggggttaacggggttaaccggggggaaccacggttacgtaacggttaacccgtaacccgggg

SEQ ID NO: 440556 - DNA, 775 bp, Homo sapiens
  misc_feature: GZ8MTXP01AGDTL.10.88.H11.1.454.CMB.2.raw
  modified_base (250)..(250): a, c, t, g, unknown or other
  modified_base (296)..(296): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgcccgtggggcctcagtgaagatctcctgcgaggtcttntcggttacacctttaacaccttatggcatctccgtgggtcgcgacncggcccctggacaaggacttggagggtggggtgggggtggcacggtcgtcttaaccgtaaggttcgactaacactaaatttgtgacaacgaagtaaacgttcccgaaggacaggtaacgtaccaaccaagtcgaaacccacgaacgaaccacgactacccgaacgacgaccaacctacggacccctaaacgtacgtaacgggtaaacgttagggggaacggggtaccgtaccgttaaggaaacggtacttaccggtaacggtaaacccggaaccggtaacccgggggttaacccgttaagttttaacgttttccggtcgggaccgggtaaaccgggaaacgggtaaacgggtaaaacccggggtttaaaaaaggggttccgggttaaacgggggttttcgggggttaaaaccgggggtttaacccggggggaaaccttaacggttaaaccgggtccgaaacccggggtaaccccggggg

SEQ ID NO: 440557 - DNA, 676 bp, Homo sapiens
  misc_feature: GZ8MTXP01AVULT.10.88.H11.1.454.CMB.2.raw
  modified_base (290)..(290): a, c, t, g, unknown or other
  modified_base (394)..(394): a, c, t, g, unknown or other
  modified_base (462)..(462): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagacgcctggggcctcgagtgaagatctccgtgcgaggtcttcgtggttacctacctttaacacctagtggcatctcgtgggtnccggacgcggtccccgtaggaacgaaggtcttggtagggtgggggtgggggtcggtcgacggccgtactttaaccgaaggtttcggacttaacgactaaaattntagacaacgaggtaaaacgttcccgaagggtacaggtactccaacagtacgaacaacagacctaacanacccgagacgacacctacgcctaagactacggagacgggaaacggcgaccgtagtaacgcgttacgacggaaccgtaccgacgggttaccttaattgtttaaccggcggaacggaacgaaggtaaacggttaaaacgggttaaagggttcggttaccgggttaagggtacccggggtaacggggacacgttgtaacccgaacggtaacccgggg

SEQ ID NO: 440558 - DNA, 728 bp, Homo sapiens
  misc_feature: GZ8MTXP01A3A1L.10.88.H11.1.454.CMB.2.raw
  modified_base (230)..(230): a, c, t, g, unknown or other
  modified_base (261)..(261): a, c, t, g, unknown or other
  modified_base (374)..(374): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctgaggtgaagacgccgtgggcctgagtgaagntctcgtgcgagtcttcgtgtacctacttacnctagtgcatctcgtgggtcgacgacgacggccccgtaggaacaaggtcgttggagggtgggggtgggggtggtcaggtccgtacttacgagttcgactaacaacttaaagttncgacaacgagtaaacgttcgaaggacaagtacgtacaaccgtagtacgaacccaacaacgaaccaacacgtacccgaacgaacgacctaaccgacgtaacccgtaacgtaggtaacggtaaccgtagggggaacgggaccgtaccgtaggaacgtacgtaccggtacggaaaccgaaccggtaccggttaccgttacgttcgttaacgtacggaccggtaacgggttaaaggtaaacggggttaaacgttaaaaacgggttcgggttaaccggggttaacggggttaacccgggggttaacccgggggaacctaacggttaacggtaaccgggttaacccggtaaccccggggg

SEQ ID NO: 440559 - DNA, 684 bp, Homo sapiens
  misc_feature: GZ8MTXP01BRCC7.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagactcctcctgcgaggtcttcgtggttactaccttaacacctatggctacgtctccgtgggtgcgacgcggccccgtaggactaagggcgttaggaggtcgggggtggggtggtacagccgtacttacgagtttgactaacgaactaaattgtgacaacgaagtaaacgttccaagggacaacggtagtacccaaccgatacgaacccacgaacgaccaacacgtaccgaacgacgaccaaccgacgaacccttagacgtaaggaacgttggggaacggtacgaccgtagaagtacgtacgtacggaaccgaccgtaccggtcgttaattacgttcgtacgacggacgttaaacggtagtaaaccgggttaaaagcggttaacgggttaacgggttacgggttaaccgggggaacctaacggttacgtaaccggaacccggtaacccggggg

SEQ ID NO: 440560 - DNA, 625 bp, Homo sapiens
  misc_feature: GZ8MTXP01BZMLP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacgccgtggggcctcagtgaagatctccgtgcgaggtcttcgtggttacctacctttaacacctagtggcagtcctccgtgggtcgcgacgacggcccctaggacaaggacttggagggtggggtgggggtggtcaggcgtcttaaccgaggttcggactacgaactaaattatgacaacgaaggtaaacgttcccaagggtaacaggacgtaccaccagtacgacccaacagacacactaccgaacgacgccaacacgaccttaacaacgtagaacgtggggaaggacgccgtagagatcgtagacgacgtacggaccgttatactttcgtcggcgacggaaggaacgtaacggttaaaaggttcgttaacggggtggtacgggtccgggggacagacgtcgaaccgtaaccggg

SEQ ID NO: 440561 - DNA, 724 bp, Homo sapiens
  misc_feature: GZ8MTXP01DDV3E.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcattcctttttcttggtggcagcagcaacaggtgcccactcccaggttcagctggtgcagtcgtggggctggagggtgaagacgcccgtggggcctcagtgaagatctcctgcgaggtcttcgtggttacctacctttaacacctagtggcatctccgtgggtgcgacgacggcccctaggaacgaaggtacgttggagggttgggggtgggggtgggtcaggtccgtacgttaaccgtaaggttcggacctaacgaaactaaaagttagtagacgaaacgaaggtaaaaacgttaccgaagggaaaccaaagggtaacgtaccaaccgtaacgtacgaaacccaaacgaacgaaccaactaactaccgaacggaacgaccaacgacgtacccaacgtaagtacggaacgtaggggaacggggaacgtaccgtaggaagtacgttacgacggaaaccgaccgtaccggtaccgttattacgtttaacgtcgcggacggaaaggtaaacggtaaacggttaaaaggttcggttaacgggttaagggtacgggttaaccgggggaacacggttacggtaacgaaccgtaacccgggg

SEQ ID NO: 440562 - DNA, 732 bp, Homo sapiens
  misc_feature: GZ8MTXP01DNDBV.10.88.H11.1.454.CMB.2.raw
  modified_base (224)..(224): a, c, t, g, unknown or other
  modified_base (268)..(268): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagagccgtggggcctnagtgaagatctctgcgaggtcttgtaggttacctacctttaacncctagtggcatcgtccgtgggtcgccgacgacggcccctaggaacctaaggtcttggagggtgggggtgggggtgggtcgaggtccgtacgttaaccgtaaggtttcggacttaaacaaccgttaaaatttacgtacgacgaacgaacggtaaacgtttacccgaaggaacaagggtaactaccaaccgatacgaacccatacgaaccacgactacccaagaacgtaccaacgccgtacctacaagtacgaaaccgtggggaaggtactccgtagaagtacgttacgtacggaaccggaaccgtaccggttacccgtttaattaccgtttcgacggccgggtaaacgttaaggtaaaacggtaacgggttaaaaaggttcggggttaaccgggtttaaggggttaacccgggtttcccggggggaaactacgttaaacggtccggttaacccggaacccggggg

SEQ ID NO: 440563 - DNA, 754 bp, Homo sapiens
  misc_feature: GZ8MTXP01BBWTW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctgaggtgaagagcccgtggggcctcagtgaagatctcgtgcgaggtctttcgtggttaacctaacctttaacacctagtggctatcgtccgtgggtcgcgtacgacggccccgtaggaacaaggtacgttggagggtgggggtgggggtggtacgaggtccgtacgtttaaccgaaggtttcggactaacgaactaaagtttagtgacgaactaggtaaaacgttcccaagggacaggacgtacaccatacgaacccacacgacacacaccgaacgaacgacaacacgacctaacgacgtaacgggtaaacctgggggaacgggtacggacccgtagggaacgtaccgttacggtacggaaaccggaaccgtaacccgggtacccggtttaaatttacgtttaaccgtacgggacccggtaaacgggaaaggtaaacgggtaaaaccgggtttaaaaggggttcgggttaaaccggggtttaacggggttaaccgggggttaacccggggggaactaacggaacggtttaaccgggaacccggttaaccccggggg

SEQ ID NO: 440564 - DNA, 647 bp, Homo sapiens
  misc_feature: GZ8MTXP01AKSYR.10.88.H11.1.454.CMB.2.raw
  modified_base (519)..(519): a, c, t, g, unknown or other
  modified_base (547)..(547): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccgtggggcctcgagtgaagatcctccgtgcgacggtcttctggttaacctacctttaacacctagtaggctatcgtccgtgggtcgcgacgaccggccccgtaggacaaggtacttggagggtgggggtgggggtcgggtcaggtcgtcgtttaaccgtaaggttcggactaacaactaaatttgtacgacaacgaggtaaaacgttccgaagggacagacgtccaaccgatacgaaccacaacgacaacactaccaacgacgaccacacgacctacagtacggtaacgaggggaacggagccagagtancgacgacgaccgtaccggtacgtacttnttaacgtcggccggacgacggtaaggtaaacgttaaggttcggttacgggtaacgggtagggtaacccgggggacacgacgtaaccgaacggaacccggg

SEQ ID NO: 440565 - DNA, 590 bp, Homo sapiens
  misc_feature: GZ8MTXP01DHSEM.10.88.H11.1.454.CMB.2.raw
  modified_base (385)..(385): a, c, t, g, unknown or other
  modified_base (436)..(436): a, c, t, g, unknown or other
  modified_base (531)..(531): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggtcttctggttacaacctttaacacctatggcatctccgtgggtgcgacgacggccccctgggacaaagggctttggaggtgggggtgggggtgggtcacggcgtacgttaaccgaaagtttcgggactaacaacaaaattttanagctaacagaaaaacgttccaagggaacaggaatcaaccatgaccacgaanaacacacacaacgagacaacacgaccaacaagtaggaagaggggaaggacgacgtagagatacgtagaacgacgtacgtacgtacttattcgtgngcgagaagtaagttaaagttagacggtaaggtaggtaacgggacgagagtgaacgaacg

SEQ ID NO: 440566 - DNA, 703 bp, Homo sapiens
  misc_feature: GZ8MTXP01BDNV9.10.88.H11.1.454.CMB.2.raw
  modified_base (273)..(273): a, c, t, g, unknown or other
  modified_base (386)..(386): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtgaagacgccgtgggcctcgagtgaagctctctgcgagtcttcgtaggttacctacctttaacacctntggctactctccgtgggtcgccgacgacggccccgtaggacgaaggtcgttggagggtgggggtgggggtggtcaggcgtacttaccgagttcgactaaacaactaaactttngacaacgaaggtaaacgttaccgaagggtacaaggtacgtaccaaccgagtacgaacccacgaacgaaccaacgactaccgaacgacgaccaacgaccgacctaacgaacgtaacgggtaaaccgtagggggaaacgggtaccgtacccgtagggaaacgtacgtccgtaacggaaaccggaccgtaaccgggtacccgtttacttaacgtttcgacgggacggaacggaaggtaaacggtaaacggttaaaggttcggttaacgggttgggtacgggttaaccggggatacgacggtaacgaaccgtaacccgggg

SEQ ID NO: 440567 - DNA, 776 bp, Homo sapiens
  misc_feature: GZ8MTXP01A56T6.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtcgcccactcccaggttcagctggtgcagtcgtggggctggaggtgaagcgccgtggggcctcgagtgaagactctccgtggcgaggtcttcgtacggttaacctacctttaacaccttagtcggctactccgtccggtgggtcgccggaacgaccgggccccgtagggaactaaagggtcgtttgggagggggttggggggttcgggggtggtacgacggtcccgttaccgtttaaccgtaggtttcggaccttaaacaacttaaattgtacggacctaacgtaaggtaaaccgtttaccgaaggggaactaacgggtacggtacccaaacctagtaccgaaacccaacgaacgaaccactacacccgaacgacgaccaaccgacgacccttagacgtacgggacgtaggggaacggacgtccgtaggaacgtacttccgaacgggaaccgaaccggtaccggttaccgttaatttcggttccgacgggcggaaccggaaaggtaaacggtaaacggggttaaaacggttcggggttaacggggttaacggggttaaccgggggttccccgggggaacaccgggttaacggtccggaacccgggtaacccggggg

SEQ ID NO: 440568 - DNA, 738 bp, Homo sapiens
  misc_feature: GZ8MTXP01D5BMO.10.88.H11.1.454.CMB.2.raw
  modified_base (235)..(235): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagntctccgtgcgaggtcttcgtaggttacctacctttaacaccttagtcggactatccgtccggtgggtcgaccgacgaccggtcccccgtaggaaccgaaaggtcgttggagggttgggggtgggggtacggtcaacggccgttaaccttaacgtaaggtttcggacctaaacgaacgttaaaagttgtacggactaacgtaaggtaaaaccgttccgaagggaacagggtaactccaacgtatacgaaccacgacgacacactaccgaacgacgacacacgtacctaacgagtaaggaaccgtagggggaacggacgtaccgtaggaacgtacgtacgaacggaaccgaacggtaccggtaccgttaatttacgtttcgtacggaccggtaggaaacggtaaacgtaaacgggttaaaacggttcgggttaacgggttaagggttaacccggggttaaccgggggaacacggttacgtaacggttaacccggtaacccggggg

SEQ ID NO: 440569 - DNA, 738 bp, Homo sapiens
  misc_feature: GZ8MTXP01CBEM6.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtagaagacggcccgtggggcctcgagtgaagactcctccgtgcggaggtcctttcgtacggttacctaacctttaacaccttagtggactatccgtccgtggggtcgcgaccgacggcccccgtagggaaccaagggtcgttgggtaggggttggggggtcgggggtggtcacggtcgtacgttaccgtaaggttcggacttaacaactaaagtttcgacgtacaaacgtacggtaaaacgttcccgaaggaaccgtaggaccgtacaaccgtaacgtacgaacccaaacgacaaccacgactaccgacgacgacaacgacgacctaacgagtacggaaaccgtgggggaacgggacgtaccgtaggaacgtacgtccggtaggaaacccggtacgtaaccggggttccttacgttactttcgcggttcggaacgttaggtaaaggtaacggttaaaagggttcggttaacgggtaacgggttaacggggccgggggtaaacacgttacggtaacggaaccgtaaccggggg

SEQ ID NO: 440570 - DNA, 704 bp, Homo sapiens
  misc_feature: GZ8MTXP01CSXER.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtgggggcctcgagtgaagatctcctgcgaggtcttctggttacacctttaacacctatggcatctccgtgggtgcgacgacggcccctaggacaaggctttggagggtgggggtagggggtgggcaggtccgtacttaccgaaggttcggactacgaactaaaatttagtagactaacgaaggtaaaacgtttccgaaggtacagtaacgtcaacccagtacgaaccaacaacgacaacactacccaacgacgacaacacgacctacaagtaggaacgtaggggaacggagtaccgtaggaacgtacgtacgtacggaaaccgaccgtaccgggtacccgttaagtttaaccgtttcggttaacggacggaaccggttaggtaaaacggtaaccgggttaaaaaagggttcggttaaacgggtttaacgggttaaacgggtttccggggggaaccgtaacgacggttaacgaacccggtaaccccggggg

SEQ ID NO: 440571 - DNA, 774 bp, Homo sapiens
  misc_feature: GZ8MTXP01DZU8C.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagccgtggggcctcagtgaagatctccgtgcgaggtcttctaggttacctacctttaacacctatcggctatcgtccgtgggtcgaccgacgacggccccgtaggaacaaagggacgttggagggtcgggggtgggggtggtcgaggtccgtaccgttaaccgaaagtttcggactaaactaactaaaatttagtgaccaaacgtaaggtaaaacgttacccgaaggggaacctaaagggtaacgtacccaacctaaacgtacggaaaccccaacgtaaacgaaccaaccgtaacgtaacccaaccggaacggaccctaaaccgaccgacccgttaaacaacggttaacgggaaaccgttgggggaaacgggtacggacccgttaagggaacctaagttaccgtacggaaaccgaccggtaacccggggtacctttaattaacgttttcgtcggaccggaacgttaagggaaacggtaaacggttaaaaacggttgggttaacggttaacgggtaacggggttccgggggaactaccgttaggtaaccgaaccggtaacccgggg

SEQ ID NO: 440572 - DNA, 694 bp, Homo sapiens
  misc_feature: GZ8MTXP01DY6AQ.10.88.H11.1.454.CMB.2.raw
  modified_base (380)..(380): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtctggggctggaggtgaagacgcccgtggggcctcgagtgaagatctcctgcgaggtcttcgtggttacctacctttaacacctatggcatcgtcgtgggtcgacgacgcggcccctaggacgaaaggtcttggaggtgggggtgggggtggtcaggccgtacttacgaagttcggactacactaaattntgacacgagaaacgttcgaaggacaggactcaccatacgaccacagaccacactaccaacgagacacacgaccaacagtacggacgtagggggaacgggacgtccgtaggtaacgacgttcgacggaaccgaaccggtaaccgggtcccgttaaatttagtttaaccgtcgggttacggaccggttaaagggtaaacggtaaaaccgggttaaaaagggttcgggttaaaccggggttaacgggggtttaacggggtttaacccggggggtaacaaccgggttacggttaaccgggaaccggtaaccccggggg

SEQ ID NO: 440573 - DNA, 607 bp, Homo sapiens
  misc_feature: GZ8MTXP01E032T.10.88.H11.1.454.CMB.2.raw
tcagcatagtagtgcacgaccggtgctcgatttagcgacagcgagaacacacaaaggggacccaaaaaccacacccctccttgggagaatcccctagatcacagctccctcaccatggactggacctggagcatcctttttcttggtggcagcagcaacaggtgcccactcccaggttcagctggtgcagtctggggctgaggtgaagagcccgtggggcctcagtgaagatctcctgcgaggtcttctggttaccacctttaacacctatggcatctccgtgggtgcgacacggccccctggacaaggtcttggaggtgggggtgggggtggtcagcgtcttaccaggttcgctacgactaaattatgcacagtaaacgttcccaaggaccagacgtcaccgatcgaacccacaacgacaacactacccaacgacgacaacacggacccttaacaagtacgggaaacctaggggagggaacgccctaggaagacttcgtagaaccggacgaccgggccctaagttatttcgtgcgacgaacgaaggaacgttaaagttggacggtgggtacggttccgggggaacacgactcgaaccgaacccggg

SEQ ID NO: 440574 - DNA, 701 bp, Homo sapiens
  misc_feature: GZ8MTXP01DDARM.10.88.H11.1.454.CMB.2.raw
  modified_base (389)..(389): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctggaggtgaagagcccgtggggcctcgagtgaagactctcctgcgaggtcttctaggttacctaccttaacacctatggcatctcgtgggtcgacgacgacggccccgtaggacgaaaggtcgttggagggtagggggtcgggggtgggtcaggcgtcttaaccgtaaggttcggactaacgaactaaaattntacgactaacaggtaaaacgtttccgaagggaactaagaacggtaccaacctaagtcgaaacccaacgaacgaacaacgaactacccaaggaacacacgaacgacctaacacgtaacggaaccgtggggaacggacgtccgtaggagtaacgtcgtacggaccgtaaccggtacggtaccgtttaattacgtttcggacggcggtaacggaaaggtaaacggtaaacggttaaaaggttcggttaacgggggttaacggtaacgggtttaaccgggggaactaacggttagtccggaaccgtaacccggggg

SEQ ID NO: 440575 - DNA, 594 bp, Homo sapiens
  misc_feature: GZ8MTXP01ACA7P.10.88.H11.1.454.CMB.2.raw
  modified_base (365)..(365): a, c, t, g, unknown or other
  modified_base (382)..(382): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctccgtgcgaggtcttctggttacctacctttaacacctatggctactctccgtgggtcgcgacgacggcccctggacaaggacttggaggtggggtgggtggtcagcgtacttacgagttgctacactaattngacacagtaaagttccngggacagagtaccacatacgaaccacagacacactaccacgacgcacacgacctacgatacggaactacgggaaggagccgtagacgagtcgtaggaccgacgtacggtaccgtattagttcgtgcggacgttaggaacgtaacggttaaaggttcggacggttgggtacgggttaaccgggggaacacgttacgtcgaaccgtaacccggg

SEQ ID NO: 440576 - DNA, 652 bp, Homo sapiens
  misc_feature: GZ8MTXP01BI7KD.10.88.H11.1.454.CMB.2.raw
  modified_base (247)..(247): a, c, t, g, unknown or other
  modified_base (284)..(284): a, c, t, g, unknown or other
  modified_base (363)..(363): a, c, t, g, unknown or other
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcagtgaagatctcctgcgaggcttntggttacaccttaacacctatggcatctccgtgggtncgacacggcccctggacaaggcttggaggtggggtgggggtggtcaggcgcttaccgaagttggctaacactaaatttngacanagtaaacgttccaaggacaggacgtcaaccatacgaacccacaagaccacactaccacgacgacacacgcctaacgagtacggaaactgggggaacggacgaccgttaggaacgtacgtaccgtacggaaccggacgtaccgggtacccgttaatttaacgtttctcgggacgtaccggaaaggtaaacggtaaacgggttaaaaggttcgggttaacgggttaaggggtaacgggttaacccggggggaactacgacggttaacggaacccgtaacccggggg

SEQ ID NO: 440577 - DNA, 650 bp, Homo sapiens
  misc_feature: GZ8MTXP01ERR27.10.88.H11.1.454.CMB.2.raw
  modified_base (286)..(286): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttacacctttaacacctatggcatctccgtgggtcncgacacggcccctggacaaaggcttgaggtggggtggggtggtcaggtccgctttaaccgagtttggactaacgaactaaaattactgacctaacgaggtaaaacgtttcccgaacgggtaacaagggacgttaccaaccctagtcgaaaccctacgaacgacaacatacccgaacgaacgccaacgacgacctacaagtacggaaccgtaggggaacggacgccgtagacggatcgtacgaacgtacgaccggtacgtacttactcgttggcgacgacgaaaggtaaccgttaaaaggttcggttaacggttaacggggtacgttccgggggaactacggaagtcggttaacgtaaccccggg

SEQ ID NO: 440578 - DNA, 634 bp, Homo sapiens
  misc_feature: GZ8MTXP01A6A0I.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtggggcctcgagtgaagatctcctgcgaggtcttctggttaccacctttaacacctagtcgctatcctccgtgggtgccgacacggcccctggactaaggcttggaggtggggtggggtggtcagtcgacgttaccgagttggctaacgactaaattgtgacacaaggtaaacgttacccaagggaccaaggacgtaccaaccatacgaaccacacgacacactccagacgcaacacgacctacaagtacggacgtaggggaaggacgtccgtagagtacgtcgtacggaaccgacgtaccggtaccgttagttacgtttcgtggccggtacgaaggaacgggtaacgttaaacgggttggttacgggtaagggtacgggttccgggggaactacgttacgtcggaaccgtaaccggggg

SEQ ID NO: 440579 - DNA, 708 bp, Homo sapiens
  misc_feature: GZ8MTXP01DSJ0L.10.88.H11.1.454.CMB.2.raw
  modified_base (87)..(87): a, c, t, g, unknown or other
  modified_base (232)..(232): a, c, t, g, unknown or other
  modified_base (238)..(238): a, c, t, g, unknown or other
  modified_base (261)..(261): a, c, t, g, unknown or other
  modified_base (265)..(265): a, c, t, g, unknown or other
  modified_base (436)..(436): a, c, t, g, unknown or other
tcagcatagtagtgcacgaccggtgctcgatttagcgacagcgagaacacacaaaggggacccaaaaaccacatccctccttggganaatcccctagatcacagctcctcaccatggactggacctggagcattcctttttcttggtggcagcagcaacaggtcgcccactcccaggttcagctggtgcagtcgtggggctggaggtgaagcgccgtgggcctgagtgaagntctcgngcgagtcttctgttacacttacnctangcatctcgtggtcgacgacgacggcccgtaggaacgaacggtacgttgggagggttcgggggtgggggtgggtcacggtccgtacgttaaccgtaggttcggactaactaaacctaaattagtacgacaacgtaaagtaacgttaacgaggaaacgagtacgtaccactanacgacaaacagaacctacaaccgtacgaacggaacacctaaccgacgtccctaaagagttacgggaaacgtagggaacggacgttacccgaggaacgtcgtaccgtaaggaccccggttaacaaccggggttcttaacgtttaactttcggacggggtaccgaaaggtaaacggtaaggttaaaacccggttaagggttacggttaaccggggttaacggttaaccgggggtaaccggggacttaacggtaacgttaacggaaaccccgggg

SEQ ID NO: 440580 - DNA, 682 bp, Homo sapiens
  misc_feature: GZ8MTXP01AIAJC.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgccgtggggcctcgagtgaagatctcgtgcgagtcttcgtggttactacctttaacacctatggctatcctccgtgggtcgccgacgaccggccccgtaggaacaaggtcttggaggttgggggtggggtggtcgagtcgtacgttaccgaggttcgactaacgaactaaattagtgacgacaaggtaaaacgttcccgaaggacgaagtacggtaccaacgacgtacgaaacccacaacgaacaaccgacacccgacgaacgacaaccgacgtaccctaacgaagtacgggtaaaccgtaggggaacgggtacggtcgtagaacgtcgtacgtacggaaccgtaccgtaccgtaccgttaagttcgttcgtcggacggacgaaggaaacggtaacgttaaaggttcggttacgggttaagggttacgggttaaccgggggaacacggttacgtcggaaccgtaacccggggg

SEQ ID NO: 440581 - DNA, 709 bp, Homo sapiens
  misc_feature: GZ8MTXP01C9VT4.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtggaagacggcccgtggggcctcgagtgaagtatcctccgtgcgaggtcttcgtacggttacctacctttaacacctagtggctactcctccggtgggtcgaccgacgaccggccccgtaggaacgaaaggtacgtttggaggggttgggggtgggggttgggtcgaggtccgtaccgttaaccgtaggtttcggacctaacaacgtaaaattgacgacaacgaaggtaaaaccgttccgaaggacaaggacgtaccaaccagtacgaacccaacaacgaaccaactacaccaaacggacgaccaaaccgtacgacccttaaacgagtaacgggaaaccgtagggggaacgggtacgtaccgtagaacgtactcgacgaacgaccgtaccggtactattcttcgcggcgacgaggtaaacgtaaacggttaaaaggttcggttaacgggttaacgggtaacggggtccggggaacacggttacgtaacggaaccggtaacccgggg

SEQ ID NO: 440582 - DNA, 680 bp, Homo sapiens
  misc_feature: GZ8MTXP01DVDHL.10.88.H11.1.454.CMB.2.raw
  modified_base (444)..(444): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggtcttcgtaggttactacctttaacacctagtcgcatctcgtgggtgcgacgacggcccctggaacaaaggtacttggaggttcgggggtgggggtggtcaggtccgtacttaaccgtagttcggactaacaaataaaacgttatgacaacgaagtaaacgttaccaagggacaggaacgtaccaacatacgaacccaanaagacaacactacccgaacgaagacaacacgaacctacaagacgggtaaacagggggaaggtaccgaccgttaggaactactcgtacggaaccgacgacggtaccttattaacttcgcggaccgtaggaaaggtaaacggtaaacggttaaaaggttcggttacgggtttaaggggtaccggggttaaccgggggaaacctacggttacgtaacgggttaacccgtaacccggggg

SEQ ID NO: 440583 - DNA, 769 bp, Homo sapiens
  misc_feature: GZ8MTXP01A6YHF.10.88.H11.1.454.CMB.2.raw
  modified_base (283)..(283): a, c, t, g, unknown or other
  modified_base (396)..(396): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtggggctggaggtgaagacggcccgtgggggcctcgagtgaagatcctcgtgcgaggtcttcgtggttaacctacctttaacacctatggcanctccgtgggtgccgacacggccccctaggacaaagggacttggagggtgggggtgggggtgggtcaggcgtcgtttaaccgaaaggtttcggacttaacaactaaacgtttanagacaacgaagtaaacgttcccaaggactaagacgtcaaccagtcgacacagacacactaccgacgacgaccaacacgaccttaacgacgtacgggtaaactggggaaggtaacgacccgttaggaacggtaactaccgttacggaacccgggaaaccgtaaccggggttaaccccgttaagtttaaacgtttccgttcgggttaaccgggtaacccgggaaacgggtaaaccgggtaaaacggggttaaaaaaacggttggggttaaaccccggggtttaaggggttaaacccggggtttaacccgggggggggttaaacccaaccgggttaacgggtttaaccgggaaaccccggtttaaaccccgggggg

SEQ ID NO: 440584 - DNA, 718 bp, Homo sapiens
  misc_feature: GZ8MTXP01BUEQE.10.88.H11.1.454.CMB.2.raw
  modified_base (269)..(269): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacttaacacctatgcanctctgggtgcgacgcggcccctggacaaaggacttggaggtgggggtgggtgggtcagcgacttaacgaaagttgactaacaactaaaattatgaccaacaaggtaaaaacgttcccaagggacaagggaacgtaccaaccaaagtacgaaacccaacgaacgaacaactaactaccgaacgaacaccaacaacgtacctaaagaacgtaacgtaaacgtacggggaaggaacggtaccgtacggaacgaacgtacgtacgaaaccggaaaccgtaaccggtaccgttaacgttaacgtttaacgttacggttacggtacggaaacggtaaacggtaaaacggttaaaaacgggttaaacgggttaacgggttaacggggttaaccggggttaacccggggggtaaccgggtaaaccgttaacggtaaccggttaaccggtaacccggg

SEQ ID NO: 440585 - DNA, 779 bp, Homo sapiens
  misc_feature: GZ8MTXP01C59Z9.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttctggttacacctttaacacctatggctatctccgtgggtcgacgacgacggccccctggacgaaaggtcgttggaggtgggggtgggggtgggtcaggtccgtacgttaaccgaaaggtttcggaccttaacgaactaaaagtttactacgacaacgtaaggtaaaacgtttaccgaagggaaacagaacgttaccaaccctagtacgaacccaacgaacgaacacactacccgaacgacgacaaccgacgaccctaaacgacgtaacgggaaacgtagggggaaacgggaaccggtaccgtaggaacgtacgttaccgtacggaaaccggaaccgtaacccgggtacccgttaacgttaaccgttttaaccggttacgggaccgggtaaccgggaaacggtaaaaccgggtaaacgggttaaaaaaacgggttcgggttaaacggggtttaacgggggttaaaccggggtttaacccgggggggaaccgtaaccggttaacggttaaccggaaccccgggtaaccccggggg

SEQ ID NO: 440586 - DNA, 672 bp, Homo sapiens
  misc_feature: GZ8MTXP01A772J.10.88.H11.1.454.CMB.2.raw
  modified_base (222)..(222): a, c, t, g, unknown or other
  modified_base (305)..(305): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagcgccgtggggcctnagtgaagatctcctgcgaggtctttcgtggttaacctaacctttaacgacctagtcggctagtcctcggtgggtcgccggacncggcccccgtaggaacgtaaaggcgttggagggtgggggtgggggtggcgaggcgtcttaaccgaaggttgactaacgaataaacgtttgcgacaacgagtaaaacgttccgaagggaactagacgtaccaaccgactacgaacccacaacgacacgtacacccgacgacgacacgacgacctaagtacgtaacggaacgtacgggggaaggtacggaccgtagaacgagttcgacggacgtacgacggtacgtacgttattcgtcggaccgtacggaagtaacggtaacggttaaacggttcgggttacggttaaggggttacgggtccgggggaactacggttacgtcgaaccggtaacccgggg

SEQ ID NO: 440587 - DNA, 700 bp, Homo sapiens
  misc_feature: GZ8MTXP01DFEU2.10.88.H11.1.454.CMB.2.raw
  modified_base (209)..(209): a, c, t, g, unknown or other
  modified_base (434)..(434): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacccggagcatcctttcttggtggcagcagcaacaggtgcccactcccaggttccagctggtgcagtcgtggggctggaggtgaagngcccgtggggcctcgagtgaagatcctcctgcgaggcttcgtggttaccacctttaacacctagtggctatctccgtgggtcgcgacgcggcccctggacaaggacttggaggtgggggtgggggtggtcaggcgtacttaccgaaggttggactaacataaattacgtggacacgaagtacgttacccgaaggtaacaagacgtaccaaccgatacgacccaanacgtacacactaccaacggacgacacctacgaccctaacgagtacggaaactacgggaaggggaacgaccgttaggacgtaacgttccgtacggaaccggaaacccgtaccgggtacccgtttaagttcgtttccgtcgggtaccggacggtaaaggaaacggtaaaccggttaaaagggttacgggttacgggttacgggttaaacgggttacccgggggaactaacggtacgttaccgaaccggttaacccgggtaaccggggg

SEQ ID NO: 440588 - DNA, 772 bp, Homo sapiens
  misc_feature: GZ8MTXP01EH3AT.10.88.H11.1.454.CMB.2.raw
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacgaggtcgcccactcccaggttcagctggtgcgagtcgtggggctggagggtagaagacggcccgtggggcctcagtagaagactctccgtgcggtaggtcttcgtaggttacctaccttaacacctagtcgactatcctcgtgggtcgacgaccgaccggccccgtaggaacgaagggtacgttggagggtgggggtggggtcggtcgaggtccgtacttacgtagttcgacctaaanaactaaattgtacgactaacgaaggtaacgttacgaaggactagacgtacaaccgatacgaaccaagacaacactaccaccgaaggacacaacgacgtaacctaacgaagtacgggaaaccgtaggggaacggaccgtaccgtagaacggtacctacggtacggaaaccggtaaaccgtacccgggttacctttaagttcctttcggggacgttaaacccgggtaacggttaaaaggtaaaaccgggggttaaaacgggttaaaacggggttcgggtttaaccgggggttaacgggggtaaccccgggggtttaaccccggggggtaaaacacccggttacgggtaaccccgggttaacccggggtaacccggggg

SEQ ID NO: 440589 - DNA, 668 bp, Homo sapiens
  misc_feature: GZ8MTXP01E2IKL.10.88.H11.1.454.CMB.2.raw
  modified_base (366)..(366): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtcgtggggctgaggtgaagagcccgtggggcctcagtgaagatctcctgcgaggtcttctggttacctacctttaacacctatggcatctccgtgggtgcgacgacggcccccgtggacaggtcttggaggtgggggtgggggtggtcagcgctaccgagttgctacactaacttangcacagaaacgttccaaggacagacgtcaccatacgaacccacagaacacactacccacgacgacaacacgacctacgagtacggaacgtggggacggacgccgtaggacgtacgttccgacggaaccggaaccgtacccgggtacccgttaatttacgtttcgtcggaccggacgggaaaggtaaacgggtaaaacggttaaaacgggttcgggttaaccggggtttaacgggggttaaccggggtttaaccccgggggggaaccaccggttacgtaaccggaacccggtaaccccggggg

SEQ ID NO: 440590 - DNA, 705 bp, Homo sapiens
  misc_feature: GZ8MTXP01BHU1M.10.88.H11.1.454.CMB.2.raw
  modified_base (256)..(256): a, c, t, g, unknown or other
  modified_base (271)..(271): a, c, t, g, unknown or other
  modified_base (276)..(276): a, c, t, g, unknown or other
  modified_base (280)..(280): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtagaagacgcccgtggggcctcgagtagaagatcctcgtgcgaggtcttntggttactaccttanactangctntcgtcgtgggtcgacgacgacggtccccgtaggacgtaaggtcgttggaggggtgggggtgggtgggtacaggtccgtacgttacgtaggttcgactaacgtaagtaaactttgcgtaacaagtaacggtaaacgttacccgaaggggaacacgggtaactccaacccgtagaccgaacccaagaacaccaacgacgtacccgaaggaaccaccgaacgaccgactaacgaggtacggaaccgtagggggacggtacgaccgttaggacgtacgtcggacgtaaacccggggactaccgggtactttacgttacgtttccgacggaccgggtaacgaaaggtaaacgtaaaccggttaaggttccggttaggggttaacgggtaccggtaacgggggaaccctaggactcggaacccgtcggggg

SEQ ID NO: 440591 - DNA, 787 bp, Homo sapiens
  misc_feature: GZ8MTXP01BCRUC.10.88.H11.1.454.CMB.2.raw
  modified_base (562)..(562): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatcctccgtgcgaggtcttctggttaacctaccttttaacaccttagtcggactatcctccggtgggtcgaccgaccgtaccggcccccgtaggaaccgaagggttacgttgggaggggttggggggttggggggtcgggtacgacggtcccgttaccgtttaaccggaagggtttcgacttaacgaaacttaaattacgtacggactaacgaaggtaaacgttacccgaagggtacaagggtacgtaccaacccgtaatcggaaacccaacgaacgaacccaacactacccgaaaccggaacgaccctaacgaaccgtacccgttaaanacggttaacgggtaaacccgagggggaaacggggtcggtacccttaggggaactacgttccggacggttaaacccggacgtaacccggggtaccttaagttccgttttcggacgacgggtacggttaaggtaaacggtaaacgttaaaagggttcggttaacggggttcggttacggggttccgggggaactacggttacggttccggaaccgttaacccggggg

SEQ ID NO: 440592 - DNA, 760 bp, Homo sapiens
  misc_feature: GZ8MTXP01A0IDS.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacggcccgtgggggccctcgaggtgaagtatcctcctgcgtaggtcttctggttacaaccctttaacacctatggcatctcgtgggtgcgacacggccccctggacgaaggacttggaggtggggtggggtgggtcaggccgacgttaccgaggtttcggcctaacgactaaacttgtgtacacgaacggaaaacgtttccaaggaacaggtacgtacaaccagtacgaacccacaagacaacactaccgaacgagaccacaacgaccctaacaagttacggaacgtacgggaacggggacgacccgttagaacggtaacgttaccgtacggaaaccggaaccgtaaccggggtaccccgttaaggtttaaccgttttaaccggttaccggggcggtaaacccgggttaacgggtaaaccgggtaaaacggggttaaaaaaccggttcgggttaaacccgggtttaacgggggtaaccggggttttaacccccgggggggggaacttaaccgggaaaccggtttccgggaaacccgggtttaaccccggggg

SEQ ID NO: 440593 - DNA, 717 bp, Homo sapiens
  misc_feature: GZ8MTXP01B1AYK.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctgaggtgaagacgcccgtgggcctcgagtgaagatctcctgcgaggtcttcgtcggttacctacctttaacaccttagtcggctacgtcctccgtgggtcgccgacgacggccccgtaggaacgaaggtcgttggagggttgggggtgggggtcggtcaggccgtacgttaaccgaaggtttcggacctaacaaactaaagtttagtgaccaacgtaaggtaaaacgttaccgaaggtaccaaggtaaccgtaccgaacctagtacgaaacccaacgaacgaaccaacactacccgaaacgacgaccgaaccgacgtacctaacgagtaggaaccgtggggaacggacgtcctaggacgtcgtacgtacggaaccgaccgtaccggtaccgttaagttcgttcgtcggacggacggaaggtaaacggtaaacggttaaaaggttcgggttaacgggttaagggttaccggggtaacccgggggtacacggttacgtaaccggaaccggtaacccgggg

SEQ ID NO: 440594 - DNA, 752 bp, Homo sapiens
  misc_feature: GZ8MTXP01EJQGP.10.88.H11.1.454.CMB.2.raw
  modified_base (238)..(238): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcgtagtcgtggggctggaggtgaagacgcccgtggggcctcgagtgaagtntctcctgcgaggtcttcgtaggttaacctacctttaacacctatcggctatccgtcgtgggtgaccggacgacggccccgtaggactaaggtcgttgagggtggggttggggttggtcgtagtcccgtagttaccgaggtttcgactaacgaacgtaaattgagacgaactaacggtaaaaccgttaccgaagggtaaccaggaacgttaccaaccgactacggaaacccaacaacgaccaacgactacccgaacgaacgacgtaacacggtacctaacgaacgttacgggaacgttacgggggaacgggacgttaccgaggacgtacgtacgtaccgggaacccgtaaccggtaaccgggttaccttaaacgttcgtttcggttacggacggtaaccgggttaaagaaaaccgggtaaaaggttaaaacgggttcgggttaacgggttaacggggttaaccggggttaaccgggggaactaccggaagttccggaacccggtaaccccggggg

SEQ ID NO: 440595 - DNA, 717 bp, Homo sapiens
  misc_feature: GZ8MTXP01EF0SP.10.88.H11.1.454.CMB.2.raw
  modified_base (460)..(460): a, c, t, g, unknown or other
  modified_base (469)..(469): a, c, t, g, unknown or other
  modified_base (481)..(481): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtagaagacggcccgtggggcctcgagtagaagtactcctccgtgcggacggtcttcgttaggttacctaaccttaacacctagtggactagtcctccggtgggtcgaccgacgaccgggtccccgtaggaacgaaggtacgttggaggggttgggggtgggggtagggtcgacggtccgtacgttaaccgtaggttcggactaaacaactaaatttgagaccaacgaagtaaacgttaccgaaggacaaggtacnccaacctanacgaaccacganacacacaccacgacacacgacgacctaacgagtaacgaacgtaggggaggacgaccgtagaagtactacgtacggaaaccgtaccgtaccgtaacgtttacttcgttaacgtacggccggaagaaacggtaaacggtaaacggttaaaaggttcgggttaacgggttaaccggggttaaacgggttaacccgggggaactacggttacgtaaccggttaaccggtaaccccggggg

SEQ ID NO: 440596 - DNA, 763 bp, Homo sapiens
  misc_feature: GZ8MTXP01DSASR.10.88.H11.1.454.CMB.2.raw
  modified_base (304)..(304): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaaggagcccgtggggcctcagtgaagatctccgtgcgaggtcttctaggttacctacctttaacaccttagtggacatcctccgtgggtcgcgaacgnggtccctcgtggaaccaaagggtcgtttggacggggttgggggtgggggtgggtcaggtcgtacgtttatcgtaaaggtttggaccttaacaaactaaaatttgtagaccgaaacaaaggtaacgttacccgaaaggggtaaccaagggtacgtaccgaacctaacgtacggaaacccaacgaacgaaccaaccgtaactaccccgaaacggaaccgaccaaaccgacgtaccccgtaaactaaggttaacgggggaaaccgttggggaaacgggaccgtacccgtaaggaaccggtattacccggtacggaaccggtaaaccgtaccgggtaccgtttaagttaccggtttcgacgggttaccgtaacgggaagttaaacgggttaaaacggttaaaaggtcgggtaacgggttcggggttaaccgggtacccgggggactaaccgaacgtaaccggg

SEQ ID NO: 440597 - DNA, 681 bp, Homo sapiens
  misc_feature: GZ8MTXP01BGA9H.10.88.H11.1.454.CMB.2.raw
  modified_base (236)..(236): a, c, t, g, unknown or other
  modified_base (277)..(277): a, c, t, g, unknown or other
  modified_base (406)..(406): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccacctcccaggttcagctggtgcagtcgtggggctggaggtgaagacgcccgtggggcctcgagtgaagntctcgtgcgagtcttctcggttacctaccttaacacctagnggctagtccgtccgtggggtcgacgacgacggccccgtaggaacgaaaggtcgtttggaggggttgggggtgggggttggtaccgaggtccgtcgtttaacgaagtttggaacctacgaactaaagttngacacgtagtaaacgttccgaaggacagtacgtcccaacgagtacgaaaccaacaacgaaccacacgtccaacgacgaccaacacgacctacgagtaacggacgtagggggaacggacgtacccgtagaaacgcttacgtacgaaccgtacgaccggtaccgttattacgtttcgcgacggacgaagtaaacgtaaggttaaaacggttcgggttaacggtaacggggtacggtaaccgggggaatacgttcgtaacggaaccggtaacccgggg

SEQ ID NO: 440598 - DNA, 634 bp, Homo sapiens
  misc_feature: GZ8MTXP01EGPK5.10.88.H11.1.454.CMB.2.raw
  modified_base (275)..(275): a, c, t, g, unknown or other
  modified_base (435)..(435): a, c, t, g, unknown or other
  modified_base (437)..(437): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacctactttaacacctatggcgtcnccgtgggtgcgacacggcccctggacaggactggagtggggtgggtggtcagcgcttaccgaagttggctacacgaaattactgacacgaagtaacgttacccaagggtaacagacgtcaaccatacgaccaacagacacataccagagacacagcctananagaaacgtcgaggggacgtaccgtagacgtatcgtacgacgtaaccgtacggtaccggttattaacgttttcggaacgtccgggaccggaaggttaaacggaaaaccggtttaaaaggttacgggttacgggttacgggtaacggttaccggggggaacaaccgtagttacggaaccgttaacgggtaacccggggg

SEQ ID NO: 440599 - DNA, 739 bp, Homo sapiens
  misc_feature: GZ8MTXP01B7A4B.10.88.H11.1.454.CMB.2.raw
  modified_base (413)..(413): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtagagacgccgtgggcctgagtgaagtactctccgtgcggtacgtcttcgttacggttaacctaacctttaacacctagtcggactatccgtcgtgggtcgaccgacgaccggtccccgtaggaacgaaggtcgttggagggttgggggtgggggtcggcgacggtccgtacgttaaccgaggtttcgaactacgtaaactaaatttgngacgaaacgtaaggtaaaccgttacccgaaggaaacgtagaccgttacccaactaacgtaccgaaaccacgagaaacccaactaccgaccaacggaacaccttaacgacctaccaaagactaagggaacctagggggaacgacgttaccgaggaacgacttcccgaggaaacccgtccgtaaccgggtcctttaaagttccgttcgacggttccgggaaacgaagggtaaaaccgtaaagggttaaacggttcggttaaccgggggttaagggttaccccgggaacggggtaacacgttagaaccggttaaccggaaccccggggg

SEQ ID NO: 440600 - DNA, 736 bp, Homo sapiens
  misc_feature: GZ8MTXP01EM8UD.10.88.H11.1.454.CMB.2.raw
  modified_base (597)..(597): a, c, t, g, unknown or other
tcagcatagtagtgcacgaccggtgctcgatttagcgacagcgagaacacacaaagggaaccaaaaaccacacccctccttgggagaatcccctagatcacagctcctcaccatggactggacctggagcattccttttcttggtggcagcagcaacgaggtcgcccactcccaggttcagctggtgcagtcgtggggctggaggtagaagacgcccgtggggcctcgagtgaagatcctctgcgaggtcttcgtaggttacctaccttaacacctagtggactatccgtcgtgggtcgacgacgacggcccctaggacgaggtacgtggacggttgggggtgggggtggtcaggccgtacgttaaccgtaggtttcggaccttaacgaaactaaattagtacgaaccaagtaacggtaaaacccgttccgaagggtaacacggtaacgttaccaaacccgtagtaccgaaacccaacaacgaaccgaactacgaccaacgacgacacgacgtaccacgtaagtacggaacgtagggggaacgacgtaccgtaggtacgagtccgtaacggaaccgtaccgtccgggtaacccgttnttaacgttcgtacgaccgggaacggttaacggaaacggttaaaacggaaagggttcgggttaacggggtttaacgggtaaccggggttaaccgggggtaaacaccggttaagtaaccggttaacccggtaacccggggg

SEQ ID NO: 440601 - DNA, 685 bp, Homo sapiens
  misc_feature: GZ8MTXP01A96P5.10.88.H11.1.454.CMB.2.raw
  modified_base (523)..(523): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagacgcccgtggggcctcgagtgaagatctcctgcgaggcttcgtcggttactacctttaacaccttagtcggctatcctccgtgggtgcgacacggcccctagggacaagggtcttggaggtgggggtgggggtaggtcaggtcgtcgttaaccgaaggtttcggactaaacgaacctaaaagtttctaggaccaacgaaacggtaaaacgtttacccgaagggtacaaacggggacgttaccaaccgaagtacgaaacccaaccgaacgaaccgaacaactaccgaacgacgacaacgacacctaacagtaggaacnggggaaggagccgtaggacgagtcgaggaacgacgtaaccgggtacctagttacgtttcgcggttacggacgttaaggaaacgtaacgggttaaaacggttcggttacgggttaaggtacgggttcccgggggaactacgacgtaacgaacgtaacccgggg

SEQ ID NO: 440602 - DNA, 680 bp, Homo sapiens
  misc_feature: GZ8MTXP01ANTRZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccgtggggcctcagtgaagatctcctgcgaggtcttctggttacacctttaacacctatggcatcctccgtgggtcgcgacgacggcccctggacaagggcttggaggtgggggtgggggtggtcgagcgtcttaccgaaggttggacttacaacgtaaacttagtgacaacgtaggaaaacgttcccaagggacagagtaccaaccatacgaccacagaacacactaccacgacgacacacgacctaacagtacggaacgtaggggaacggagtcccgtaggaacgtacgtcgtacggaaccggaccgtaacccgggtacccgttaagttacgtttaaccgttacggcggacggaaacgggtaaacggtaaacgggttaaaaggttacgggttaacgggttaacgggggttaacgggtttaacccggggggaacacggttaacggtaacggttaacccggtaaccccgggg

SEQ ID NO: 440603 - DNA, 741 bp, Homo sapiens
  misc_feature: GZ8MTXP01EXELJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcgagtgaagatctccgtgcgaggtcttcgtggttaccacctttaacacctatggctatctccgtgggtcgccgacgacggcccctaggaacaaagggtctttggagggttgggggtgggggtgggtcaggtccgtacgtttaaccaggtttcggactaaacgaataaacttagtacggactaacgaggtaaaacgggttcccggggaacagggtaacgtaccaacctagtacgaacctaacagaaccacactccgaacgacgaccacgaacgtaccctaacgacgtacggtaaaccgtaggaacgggggtaacgccgttaaggagtacgtacgtacggaccggaaaccgaccggggtaccttaacgttacgtttcgtcggtaccgggacggtaaacgggaaacgggtaaaccggttaaaagggttcgggttaccgggttacgggggttaaccggggttcccggggggaactaaccggtaggttaccggaacccggttaacccgggtaacccgggggg

SEQ ID NO: 440604 - DNA, 796 bp, Homo sapiens
  misc_feature: GZ8MTXP01B9V9G.10.88.H11.1.454.CMB.2.raw
  modified_base (247)..(247): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagctattccttttcgttggtggcagcagcaacaggtcgcccactcccgaggttcagctggtgcagtcgtggggctaggaggtaggaacgcggcccggtggggcctacgtagtagaagtntcctcgtgcgaggtcctttcgtacgggttaacctaacccttaacgacctagtcggactactccgtcggtgggtcgaccgaccgtacggccccgtaggaacgaaggtcgttgggaggggtgggggtgggggtcgtacgacggtccgttaccgttaacgtaaggtttccgaaccttaacgaaacgtttaaattcgtacgaactaaacgtaggtaaaccgttacccgaagggacctaagggacctacgaaccgtaagtaccgaaacccaacgaacgaaccacacgacgacacgaccacacgtaccagagtacggaaggtaggggacggacgtacgagaagtaccgtcgaacgaaccggaccgtaacggtacgttaacgttacgttaacgttacgggttacggacggttaaccgggtaaaagggtcggttaaaaaacccggggttaagggttacggggttaaacccggggggttttaaccggggtaacgggggtttaaccccggggggaacttaaccggggtaaaccggttaacccggggtaaaccccggggg

SEQ ID NO: 440605 - DNA, 923 bp, Homo sapiens
  misc_feature: GZ8MTXP01AKBG5.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtcgtggggctggaggtgaagacgcccgtggggcctcgaggtgaagatctccgtgcgtaggtcttcgtcggttaacctacctttaacaccttatggctatcctccgtgggtcgcgacgacggcccctaggacaaggcgttggagggtggggtgggggtgggtcagtcgtacgtttaaccgaaggtttcggacttacgaaactaaaacttacgttagaccgtaacgtaagggtaaaaacctttaccccggaaggggtaaaccgtaaacgggtaaacgggttaccccaaacccgtaaacgttaccgggaaaccccaaacccggtaaacggaaacccgtaaacccaaaccgtttacccccgaaaccgggtaaaaccgggtacccctaaaacgaaaccccggggtaccccttaaaaccccgtaaaggggtttaaacgggggaaaaccccgtttagggggggggaaaacggggttaaccgggtaacccccggtttaagggaaaccgttaaggtacccgtttaacggggaacccggtaaaccgtaaccccggggtaccgttttaaacgttaccgtttttaacggtccggttaccggggaacccggaaagggtaaaacggtaaaccgggttttaaaaacggggttcgggttaaacccggggtttaaggggttaacccgggggtttaaccggggggaacgtaacccggttagttaacccgggaacccgggttaaaccccgggggg

SEQ ID NO: 440606 - DNA, 881 bp, Homo sapiens
  misc_feature: GZ8MTXP01ANFXU.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgaggtgaagatctcctgcgaggtcttcgtggttacctaccgtttaaacaccctagtggctatcctacccggtgggtacgcgtaaccgacggtccccccgtaggacctaaagggtcctttagggagggtgggggttggggggttcgggtaccgaaggtccgtccgtttaaacccgtagggtttgggacctaaacgtaaccgtaaaattttcgaggaccaacgaaacggtaaaacggtttccccgaaagggttaccgaaaggggtactacccaaaccgtactacgggaaaccccaacgaagaacccaacaaaccgtaccccgaacggaacggaccctaaccgaaaccggttaccctaaacgaacggtttaaccggaacccggttaagggggaacgggtaaccggacccgtttaagggaacccgtagtacccggttacggaaacccggtaaccccggaaccgggttacccggttaacctttaacgtttccccgggttagttacccgggtacccggaaaagggtaaaccgggtaaaacccgggttaaaacggggttccgggttaaaccggggtttaacgggggttacccggggtttaaccccggggggggtaaacaacccgggttaaccgttaacggggttaacccccgtaaaccccggggggg

SEQ ID NO: 440607 - DNA, 673 bp, Homo sapiens
  misc_feature: GZ8MTXP01AJH7Q.10.88.H11.1.454.CMB.2.raw
  modified_base (247)..(247): a, c, t, g, unknown or other
  modified_base (263)..(263): a, c, t, g, unknown or other
  modified_base (278)..(278): a, c, t, g, unknown or other
  modified_base (283)..(283): a, c, t, g, unknown or other
  modified_base (315)..(315): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgagcttntgttacacttacactntgcatctcgtgggtncgacncggcccctaggacaggtactggaggtgggggngggtggtcagcgtacttaccgagtttggactacgaactaaattcgtgacaacgaggtaaacgttaccgaaggacaggagtaccactagtcgaacccagacgaaccacactaccagacgctaacacgtacccaagacgtaagggaaccgtagggggaacggacgtcccgtaggaacgtaacgttcgacggaaaccggacccgtaccgggggttaacccttagttaccgtttcgtacgggaccggtaacggttaaggaaacggttaaaaccggttaaagggttccggttaacgggtttaacggggtaccggggtaacccgggggtaacacgttaggttaaccgaaccggttaacccgggg

SEQ ID NO: 440608 - DNA, 715 bp, Homo sapiens
  misc_feature: GZ8MTXP01BH5DE.10.88.H11.1.454.CMB.2.raw
  modified_base (269)..(269): a, c, t, g, unknown or other
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctggaggtgaagcgccgtggggcctcagtagaagatctccgtgcgagtcttcgtcgttacctacttacactntcgcactcgtcgtggngacgacgacggcccctaggaacgaacggtacgtttaggaggggttgggggttgggggtcggtacgacggccgtacgttaaccgtaaggttcggactaacgaaactaaagttactaggaccaaacgtaacggtaaaaccgttccgggaaggtaacaaggtactaccgaaccccgtaagtaccgaaacccacaagaaccaacgacctaaccgagaaccgactaacgacgacctacgacgtagggaaccttaggggggaacgtacgtaccgtagaacgtctcggtaacggaaccgacggtaccgtacggttacttaggttcgcgcgggtacgaaagggtaacttaaacgggttaaacgggttcggttaaccgggttaaggttaaccgggggtcccggggactaacggttacggtaacgccgggtaacccgggg

SEQ ID NO: 440609 - DNA, 663 bp, Homo sapiens
  misc_feature: GZ8MTXP01DZJAO.10.88.H11.1.454.CMB.2.raw
  modified_base (384)..(384): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtggggcctcgagtgaagatctcctgcgaggtcttctaggttacctaacctttaacacctatggctatcctccgtgggtcgacgacgacggcccctaggacaaagggcttggaggtgggggtgggggtggtcagcggtcttaaccgaaggttcggactacaactaaattangtacacaagtaaacgttcccaagggacagacgtacacgatacgaaccacagacacacaccaacgacgacaacacgacctaacgagtacggaacctggggaacggtacgtacctaggacgtaccgttacgtacgaaacccgaccgtaaccggggtaccctttagttaacttttcgtcggacggaacgttaaggaaacgtaaacggttaaaagggttcgttaacgggttaacgggttaacgggttccgggggaactacgacgttcgaaccgtaacccgggg

SEQ ID NO: 440610 - DNA, 695 bp, Homo sapiens
  misc_feature: GZ8MTXP01B8NIC.10.88.H11.1.454.CMB.2.raw
  modified_base (377)..(377): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtgggggcctcgagtgaagatctccgtgcgaggtcttctggttactacctttaacacctatggcatcctccgtgggtcgcgacgacggcccctaggacaaaggtcttggaggtgggggtggggtggtcagccgtcttaaccgagttggacttaacactaaattngacaacgagtaaaacgttcccaagggacagtactccgaactagtcgaaccacgacaacacactacccacggacaccaacgacgacctacaagtagaaccgtagggacggacgtccgtgaaggtactcgtaggaacccgaacgtaccgggtacccgttatttaacgtttcgtacggaccggaacggttaaacgggtaaacggtaaacggttaaaaacggggttcgggttaacggggtttaaccgggggtaacgggtttaaccccgggggggaaccgtaacggttaacggttaaccggaacccgggttaaaccccggggg

SEQ ID NO: 440611 - DNA, 671 bp, Homo sapiens
  misc_feature: GZ8MTXP01B2UBU.10.88.H11.1.454.CMB.2.raw
  modified_base (236)..(236): a, c, t, g, unknown or other
  modified_base (301)..(301): a, c, t, g, unknown or other
  modified_base (534)..(534): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagtntctccgtgcgaggtcttctacggttacctaccctttaacacctagtcggctactcgtcgtgggtnccgacgcggcccctggacaaggtcgtggaggtgggggtgggggtggtcaggccgtacgttaaccgtaggttcgaccttaacaactaaagttgcgacaacaggtaaacgttaccgaaggaacaggtacgtaccaacctagtaccgaacccaacgaacaaccgaactactacccaacggacgacctaacgacgacccttagaagtacgaaccgtggggaacggtacgctaagganaccgttcgacgaccgacgtacggtcctattccgttgacgcggacttaaggaaacgtaaacgttaagggttcgttacgggttaacgggaacgggttcccggggaactacggttacgtaaccgaacggtaaccccgggg

SEQ ID NO: 440612 - DNA, 707 bp, Homo sapiens
  misc_feature: GZ8MTXP01E17DI.10.88.H11.1.454.CMB.2.raw
  modified_base (233)..(233): a, c, t, g, unknown or other
  modified_base (273)..(273): a, c, t, g, unknown or other
  modified_base (434)..(434): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcaacaacaggtcgcccactcccaggttcagctggtgcagtcgtggggctggaggtgaagcgcccgtggggcctgagtgaagntctctgcgagtcttcgtagttactaccttaacactatgcntctcgtggcgcgacgacggccctaggacaaggtctggaggtgggggtgggtcggtcacggtcgtacctttaaccgaggttcggacctaacaaacgtaaatttcgcgacaacgtaaggtaacgttaaccagggaacaggtacgtccaacagtacgaaccaanaacgacaacacaccgaacgacgaccaacgacgtaccgaaatacgtaacgggaaacgtagggaacggggacgtacgtagaagtacgttaccgaacggaaccgaccgtaccgggtcgttaattcgtttccggcggtacgggaaacgggtaaggaaacgggtaaaacgggttaaaagggttccgggttaacggggtttacgggggttaaccggggtacccggggggtaacaacggtacggttaccggaaccggttaacccgggggtaacccggggg

SEQ ID NO: 440613 - DNA, 678 bp, Homo sapiens
  misc_feature: GZ8MTXP01EG1VT.10.88.H11.1.454.CMB.2.raw
  modified_base (447)..(447): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcctggggctcagtgaagatctcctgcgaggtcttctggttacctactttaacacctagtggcatctacgtgggtcgcgacgacggccccgtaggaccaaggtacgtggaggttggggtagggggtcggtcaggcgtacgttaccgaaggtttcggactaacaacgtaaatttgtacggacaacgagtaaaaacgttcgaagggactaaggacgtaccaccgatcgaaccacgagaccanactccaagacgcaacgacgaccctagaagtaggaacctaggggacggggacgtaccgttagacgtaacgtccgtaggaaacccgggtacgtaacccgggtaccgtttacggtaaacttttcggacgggttacggacgggttaaaggaaggtaaaccgggtttaaaggcggttaacgggttggggttacggttaaccgggggactaacgaggtaaccgaacggtccccgggg

SEQ ID NO: 440614 - DNA, 765 bp, Homo sapiens
  misc_feature: GZ8MTXP01DASA8.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagatctctgcgagtcttctggttactaccttaacacctagtggctatctcgtgggtgcgacgacggccccgtaggacaaaggtcgttggagggtgggggtgggggtggtcgaggtcgtacttaaccgtaaggtttcggactaacaactaaattagtcgacgtaacaggtaaaacgttaccgaaggacagacgttaccaaccgtagtacgaaacccacgaacgaaccaactacaccgaacgagaccaacgacgaccttaacgaagtacggaaaccgtgggggaaacggtacgtccgttaacggagtaaccgttcggtaacggaaccgaacccggtaaccgggttacccgttaacgtttaagttttaacccggtacgggttaccggacgggaaacgggtaaaacgggtaaacgggttaaaaaagggttccggggttaaacgggggtttaacggggttaaacccgggggtttaacccggggggggaaactaccggttaacggttaacccgggttaaacccggttaaccccgggggg

SEQ ID NO: 440615 - DNA, 700 bp, Homo sapiens
  misc_feature: GZ8MTXP01BB3YE.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtcgcccactcccaggttcagctggtgcagtcgtggggctggaggtgaagcgcccgtggggcctcgagtagaagactctcgtgcgagtcttcgtacgttacctaccttacactatcggctactcgtcgtgggtcgaccgacgacggccccgtaggaacgaaggtacgttgggagggttgggggtggggtcgggtacacggtccgtacgttaaccgtaaggttcggactaaacaagttaaacttgagacgacgtaacggtaaaacgttcccgaaggtacacggtacgtaccaaccgacgtacgaaacccaacacgaaccacgtacacccgaaagacgaacctaacgacgtacctaaacgagtacgggtaacctgggggaacggtagccgttaagacgtactcggtaacgaccgtaccgtaccggtacttaagtcgttaacgcggttacggacgaaaggtaaacggtaacggttaaagttcgggaacggttaagggtaccggggttccgggaacacggttacgtaacgaaccggtaaccgggg

SEQ ID NO: 440616 - DNA, 745 bp, Homo sapiens
  misc_feature: GZ8MTXP01AS4GP.10.88.H11.1.454.CMB.2.raw
  modified_base (698)..(698): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagacggcccgtggggcctcgagtagaagtactccgtcgtggcggtaggtcctttcgttacgggtttaacctaaccttttaaaccaccttagtcgggtctaactccgttccggtggggtcgaccggacgaccgggccccgtagggaacgtaaacgggtacgtttgggtacggggttggggggtagggggttgggtacacggtccgtaccgtttaaccgaaggttcggactaaacaacgtaaaactttagcgacgaacgaaggtaaacgttaccgaagggacgtagacgttacccaaaccagtacgaaacccacgaacgaacaacctacgaacccaggaacgaccaacccgacgtaccgtaaacgtaacgtacggggtaaaccgtgggggaaacggggtacgtcccgtaaggaacgtaaccgtcgtaaccggaaaccgacggtaccgggtaaccgtatttacgtcgtcggcgagagtaacgaaggttaaaggngacgggttaagtacggggtccgggacagagtaacggccgtaacgggg

SEQ ID NO: 440617 - DNA, 755 bp, Homo sapiens
  misc_feature: GZ8MTXP01CH0GL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtcgcccactcccaggttcagctggtgcagtcgtggggctggaggtgaagaggcccgtggggcctcgagtgaagatctccgtgcgaggtcttctcggttactaccttaacacctagtggtcatctccgtgggtgtcgacgacggcccctaggacgaaggtacgttggagggtgggggtgggggtgggtcgaggtcgcgtttaaccaaggttcggactaacgaactaaaatttattaggactaacgaaggtaaaagtttacccgaagggtaaccaaagggtacgtaccaaccgaactcggaacccaacgaagacccgaacactaccaacgacgacaacacgcctacagagggtaactaggggaacggggagccgtacggagtacgtacgtggtaaccggaaccgtaccggtacccggttaacgttacgttttccggttacgggacgggttaccgggaaacggtaaacggggaaaacccgggttaaaaaggggttacggaacgggggtttaacggggttaaaccggggttaacccgggggggggttaaaccccgaaggttacggtttaacccgggaaccggttaaaccccgggggg

SEQ ID NO: 440618 - DNA, 840 bp, Homo sapiens
  misc_feature: GZ8MTXP01BYKKI.10.88.H11.1.454.CMB.2.raw
  modified_base (482)..(482): a, c, t, g, unknown or other
  modified_base (531)..(531): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctggaggtagaagacgcccgtgggcctacagtagaagtactcctccgtggcgtaggtctttcgtaggtttaacctaaccctttaacaccttagtcggactactccgtccgtggggtacgaccgacgtaccggcccctaggaacgtaagggtacgttgggacggggttgggggtcgggggtggtacgaggtcgtaccgttaacgtaggtttcgactaacgtaacttaaatttacgagacaacgtaaggtaaaaccgttcgaaggtacacggtacgtaccaacgtanaccgacccaagacgaacctaacacgtacccgaacgaacggcctaaaccncggtaaccctacggaacgttacgggaaccgttagggggaacggtacgtacccgtaggtaaccgtatcccggtaacggtacccgaaaccgggttacccggtaaccggtttttaaacgtttaacccggttttccggacggggttaaaccccgggaaagggttaaacgggttaaaaccggggtaaaaaccgggttttaaaaggggttcgggggttaaaccccgggttttaagggggtaaaccccgggggtttaacccgggggaaactaccggttaaaacgggtccgggttaaaccccggtaaccccgggggg

SEQ ID NO: 440619 - DNA, 766 bp, Homo sapiens
  misc_feature: GZ8MTXP01BN132.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccacctcccaggttcagctggtgcagtcgtggggctggaggtgaagacgcccgtgggcctcgagtgaagatctccgtgcggtaggtctttcgtacggttaccttaaccctttaacaccttagtcggactactcctccgttggggtcgaccggtaccgaccggtcccccgtagggaaccgtaaagggtaccgtttgggaggggtttggggggttgggggtttacggggtacacggtaccgttccgtttaaccgtaaggtttcgggaccttaaacgaacttaaaatttgtacgacaacgtaacgtaaaacggtttaccgaaggaactaggacgtaccaacccgagtacggaaaccctaacgacgaacgaacctacgtacccgaacggacgaccaacgaccgtacctaacgagttacggaccgtaggggacggtacgcgtggaatcgtacgtacggaaccgtacgtaccggttacgtatttcgttcgtcggttacgcgggaaacggtaacggtaaacggttaaaggttcgggttacgggttaacggggttaaccggggtaaccgggggaactacggacgttaaccggaacggtaaccccggggg

SEQ ID NO: 440620 - DNA, 650 bp, Homo sapiens
  misc_feature: GZ8MTXP01AQP76.10.88.H11.1.454.CMB.2.raw
  modified_base (276)..(276): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagactctccgtgcgaggtcttgtaggttacctactttacacctancgctatcctcggtggtcgacgacgacggccccgtaggaactaaggacgtttgggagggtgggggtggggtaggtcaggtccgtacgttaaccgaggtttcgactaacgaactaaattctagaccaagaagtaaacgttcgaaggacagtacgaccaccatacgaccaacgcgtaaccacgactccgaacgataccgacacgacctacgtagacggaaccgtgggaacggcgtacgtaggaacgtcgcgtagaaccgcggtacggtacgttacttagttcgcggagacggttaagaaagtaacggttaaaggttcgttacgggttaacgggtcggggttaaccgggacaccggttagtccggaaccgtcccgggg

SEQ ID NO: 440621 - DNA, 732 bp, Homo sapiens
  misc_feature: GZ8MTXP01CFV04.10.88.H11.1.454.CMB.2.raw
  modified_base (412)..(412): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagtactctcctgcgtaggtctttcgttcggttaaccacccgttttaaacacccttagtggcctatccgtcccgtggggtcgaccgacgacgggccccccgtaggaaccgaaggtaccgtttgagggtgggggttgggggtgggtccaggcgtacttacgaggtttcggacttacgaactaaattntagccaagtacggtaaaacgttcccgaagggacaagtacgtccaacctagtacgacccacgaacgaacaccactacccaacgacgacctaaccgacgtaccctacgagtacgggaaccgtagggggacggtacggtaccgtacggaaggtacgtcgtacggaaccgtaccgtaccggtacccgttacttacgtttcgtcgggaccgacgggaacggaaacggtaacggttaaaacggttcgggttaccgggttaaggggttaccgggttaacccggggggaaccgtacgttacggttaacggaacccggtaaccccgggg

SEQ ID NO: 440622 - DNA, 746 bp, Homo sapiens
  misc_feature: GZ8MTXP01B5JWP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacggcccgtggggcctcgagtgaagatctcctgcgaggtcttcgtggttacctaacctttaacacctagtcggcatcctccggtgggtcgaccgacgacggccccctaggacgaaggtcttaggagggtggggggtgggggtggtcaggtcgtacttacgaggttggactacaactaaattgtgacaacgagtaaacgttccaagggactaggagtaccacagtacgaaccacagaaccaactactacccgaaacgacgtaccaacgaacggtccctaaacgtaaggttaacgggaaacgttacggggggaaacggtaacggtacccgttagggaacgtaactccggtagggaaaccccggtaacgtaacccggggttacccgtttaaattacgttttccgagggttcccggaaaggttaaacgggaaaacggttaaacgggttaaaacgggttcgggttaaacgggtttaacgggggttacccggggttaacccgggggaactacgttaggttaaccggaacccgtaacccggggg

SEQ ID NO: 440623 - DNA, 702 bp, Homo sapiens
  misc_feature: GZ8MTXP01CYQ9L.10.88.H11.1.454.CMB.2.raw
  modified_base (394)..(394): a, c, t, g, unknown or other
  modified_base (439)..(439): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcattccttttcttggtggcagcagcaacaggtcgcccactcccaggttcagctggtgcagtcgtggggctggaggtgaagacgccgtgggcctgagtgaagatctccgtgcgaggtcttcgtcgttacctacctttacacctagtgcactcgtccgtgggtcgccgacgaccggccccgtaggacgaaggtacgttggagggtggggtgggggtggtcgacgtcgacgtttacgtaagttcggtactaactaacctaaattagngacacgtaaagtaacgtccgaggacagacgtaccacatacgacanacgacacactaccgacgacgacaacacgtaccactagacggaacggtaggaacggacgtacgtggaacgtacgtcgtacgaaccggtaaccggtacccggttaccgttaagtttaacgttaccgacgggtaccggaccgggtaaagggtaaacgggttaaaacccggttaaaagggttcccgggtaacggggttacgggggtttaacccggggtaccccggggggaaacttaacgttaaccgggttaaccggtaaccccgggg

SEQ ID NO: 440624 - DNA, 709 bp, Homo sapiens
  misc_feature: GZ8MTXP01EVSHR.10.88.H11.1.454.CMB.2.raw
  modified_base (209)..(209): a, c, t, g, unknown or other
  modified_base (232)..(232): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctgaggtgagngcccgtggggcctcgagtgaagntctcctgcgaggtcttcgtggttaacctacctttaacacctatggctactctccgtgggtgcgacgacggccccgtggacaaaggcttggaggttgggggtggggtggtcaggccgctttaacgaggttcggactaacaactaaagtttatcgacaacgaggtaaaacgttccgaagggtaacaagggacgtaccaaccgtacgtacgaaacccgaacacgaaccaactacgtacccacgacgacacaacgacctacacgtagaactaggggacggacgcgtacgaagtacgttaccgacggtaaccgaccgtaaccgggtacccgttagtttaacgtttcgttaccggaccgggtacggaaacggtaaacggtaaacggttaaaaacggttcgggttaacgggttaaggggttacccgggtttaacccggggggaataaccggttaacgttaaccgggaaccccgtaacccggggg

SEQ ID NO: 440625 - DNA, 522 bp, Homo sapiens
  misc_feature: GZ8MTXP02GA101.10.88.H11.1.454.CMB.2.raw
  modified_base (280)..(280): a, c, t, g, unknown or other
  modified_base (347)..(347): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacacggcccctggacaaggcttgaggtgggtggtggtcagcgcttacgagttgctacacaaattntgcacagaagttccaggacagagtcaccatgaccacagacacataccacgacgcacagcctacataggaactgaggagcctagagatctgacgacgacggaccgtatattctgcgcgagagaacgtaaaagtgacgtaaggtacggttacgggggacacgactacgacgtaccgg

SEQ ID NO: 440626 - DNA, 515 bp, Homo sapiens
  misc_feature: GZ8MTXP02GTH5E.10.88.H11.1.454.CMB.2.raw
  modified_base (280)..(280): a, c, t, g, unknown or other
  modified_base (348)..(348): a, c, t, g, unknown or other
  modified_base (390)..(390): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttgagtgggtggggtggtcagcgcttaccagttgctacacaaattngcacagaagttcaggacagagtcaccatgaccacagacacanccacgagacacacgcctacataggaactagaggagacctagagatctagacgacgacggccgtatattctgcgcgagacgacgtaaaagtgacgtggtacgtcgggggacacgatacgacaccgg

SEQ ID NO: 440627 - DNA, 522 bp, Homo sapiens
  misc_feature: GZ8MTXP02FIQAW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttggagtggggtggggtggtcagcgcttacagttgctacacaattatgcacagaagttccaggacagagtcaccatcgaccacagacacatccacgagcacacgcctacataggaactaggaggagacctagagatctagacgacgacggccgtatattctgcgcgagacgacgtaaaagtgacgtggtacgtaccgggggacacgatacgacgaccgg

SEQ ID NO: 440628 - DNA, 514 bp, Homo sapiens
  misc_feature: GZ8MTXP02F4RGD.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttaccaagttggctacacaaattatgcacagaagttccaggacagagtcaccatgaccacagacacatccacgagcacagcctacataggaactgaggagcctagagatctgacgacacggaccgtatatttctgcgcgagagacgtaaaagtgacgtggtacgtcgggggacacgagtcgactaccgg

SEQ ID NO: 440629 - DNA, 514 bp, Homo sapiens
  misc_feature: GZ8MTXP02IM6XM.10.88.H11.1.454.CMB.2.raw
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtggtcagcgcttaccaagttggctacacaattatgcacagaagttccaggacagagtcaccatcgaccacagacacanccacgagcacagcctacatagaactgaggagcctgagatctgacgacgacggacgtatattctagcgcgagacgacgtaaagtgacgtggtagttcggggactacgagtacgactaccgg

SEQ ID NO: 440630 - DNA, 563 bp, Homo sapiens
  misc_feature: GZ8MTXP02HLE19.10.88.H11.1.454.CMB.2.raw
  modified_base (281)..(281): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttaccgaagttggctacgacaaattatgcacagaagttccaggacagagtcaccatgaccacagacacactcacgagcacacgacctacataggaactaggaggacgcctaggagatcgtagacgacgacggtaccgtagttaactttcgtagtcgacgaaggaacgaaacggtaaaagtaggtaacggtaagggtacggttaccgggggaacacgacgtacgaaccgtaacccgggg

SEQ ID NO: 440631 - DNA, 521 bp, Homo sapiens
  misc_feature: GZ8MTXP02G31MB.10.88.H11.1.454.CMB.2.raw
  modified_base (281)..(281): a, c, t, g, unknown or other
  modified_base (354)..(354): a, c, t, g, unknown or other
  modified_base (463)..(463): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttaccaagttggctacacaaattatgcanagaagttccaggacagagtcaccatgaccacagacacatccacgagcacagcctacataggaactggaaggagacctgagatctgacgacgacggcgtagtactttcgngcgcgagacgacgtaaagtgaggtggtacgttaccgggggacacgactcgacgtacgg

SEQ ID NO: 440632 - DNA, 548 bp, Homo sapiens
  misc_feature: GZ8MTXP02JWEXH.10.88.H11.1.454.CMB.2.raw
  modified_base (280)..(280): a, c, t, g, unknown or other
  modified_base (349)..(349): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttgagtgggtgggtggtcagcgcttaccgagttggctacacaaattngcacagaagttcaggacagagtcacatcgaccacagacacactaccacgacgacacacgcctacagtaggaactggaggagaccgtagagacgtacgacgacgaccgacggtaccgtatacgtttctgacggcgaaggagtaacgtaaaagtacgacggtaaggtacggttaccgggggacacgagtacgacgaccggg

SEQ ID NO: 440633 - DNA, 508 bp, Homo sapiens
  misc_feature: GZ8MTXP02HY3XZ.10.88.H11.1.454.CMB.2.raw
  modified_base (280)..(280): a, c, t, g, unknown or other
  modified_base (343)..(343): a, c, t, g, unknown or other
  modified_base (348)..(348): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctctgcgaggcttctggttacacctttaacacctatggcatctcctgggtncgacacggcccctggacaaggacttgagtggggtggggtggtcagcgcttacagttgctacanaattngcacagagttcagacagagtcaccatgacccacagacacactaccacgagcacacgacctacataggaactgaggagctagagatctagacgacgacgccgtatattctgcgcgagagacgaaagtgacgtgtacgtacggggacacgagtcgacgacgg

SEQ ID NO: 440634 - DNA, 515 bp, Homo sapiens
  misc_feature: GZ8MTXP02JYDTD.10.88.H11.1.454.CMB.2.raw
  modified_base (347)..(347): a, c, t, g, unknown or other
tcagcatagtagtgcacgaccggtgctcgatttagcgacagcgagaacacacaaagggacccaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccagttggctacacaaattntgcacagaagttccaggacagagtcaccatgaccacagacacataccacgagcacacgacctacataggaactgaggagcctagagatctagacgacacggaccgtatatttactgcgcgagacgacgtaaagtgacgtggtacgtcgggggacacgagtcgacacgg

SEQ ID NO: 440635 - DNA, 525 bp, Homo sapiens
  misc_feature: GZ8MTXP02IIT9Q.10.88.H11.1.454.CMB.2.raw
  modified_base (341)..(341): a, c, t, g, unknown or other
  modified_base (349)..(349): a, c, t, g, unknown or other
  modified_base (395)..(395): a, c, t, g, unknown or other
  modified_base (406)..(406): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttaccagttggctanacaaattntgcacagaacgttccagggcagagtcaccatcgaccacagacacanccacgagcacngcctacataggaactgaggagcctgagatcgtgacgacacggacgtagtatttactgcgcgaagagacgtaaaagtggtacggtggtacggttacgggggacacgagtacgacgaccgg

SEQ ID NO: 440636 - DNA, 550 bp, Homo sapiens
  misc_feature: GZ8MTXP02GZJ95.10.88.H11.1.454.CMB.2.raw
  modified_base (206)..(206): a, c, t, g, unknown or other
  modified_base (354)..(354): a, c, t, g, unknown or other
  modified_base (358)..(358): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagngcctggggcctcagtgaagatctcctgcgaggcttctggttacacctttaacacctatggcatctccgtgggtgcgacacggcccctggacaaggacttgaggtggggtggggtggtcagcgtcttacgaagttggctacacaaattngcanagagttccagggacagagtcaccatcgaccacagacacactaccacgagccaacacgacctacagtaggaactaggaggacgcctaggagacgtctaggacgacgacggccgtatactttcgtgcgacgagacgaacgtaaaaggtgacggtgggtacggttaccgggggacacgacgtacgacgtaccggg

SEQ ID NO: 440637 - DNA, 537 bp, Homo sapiens
  misc_feature: GZ8MTXP02HJAT6.10.88.H11.1.454.CMB.2.raw
  modified_base (281)..(281): a, c, t, g, unknown or other
  modified_base (392)..(392): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttacaagttggctacacaaattatgcacagaagttccaggacagagtcaccatgaccacagacacanccaacgagcacacgcctacataggaactagaggagcctagagatactagacgacacggaccgtataatttctgtcgacgaggaagaacgtaaaacgtagaacggtaaggtacgttaccgggggacaacgagtacgtacgaaccgg

SEQ ID NO: 440638 - DNA, 614 bp, Homo sapiens
  misc_feature: GZ8MTXP02J1E3Q.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcgagtgaagatctcctgcgaggcttctggttacacctttaacacctatggcatctccgtgggtcgcgacgacggcccctggacaaggacttggaggtggggtggggtggtcgagcgtcttaccgaaggttcggactacaactaaattagtgacaacgagtaacgttccgagggtacaggtacgtcaccatacgaccacagacacactccacgacgacaacacgacctacacgtaggaacgtaggacggacgaccgtagacgtacgtacgtacgaaccgacgaccggtaccgtaagttactttcgtacggcggacggtaaggaacggtaacgtaaaacggtacggtacggtaagggtacggttaccgggggactacgtacgtacggacgtaccggg

SEQ ID NO: 440639 - DNA, 635 bp, Homo sapiens
  misc_feature: GZ8MTXP02JTTL6.10.88.H11.1.454.CMB.2.raw
  modified_base (281)..(281): a, c, t, g, unknown or other
  modified_base (353)..(353): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatgtcatctcctgggtncgacacggcccctggacaaggacttgaggtggggtggggtggtcaggcgcttacagttgctacactaaattntgcacagaagttccagggacaggacgtcaccatcgaccacagacacatccacgagcacacgcctacagtacggaaacgtaggaaggacgccgtaggaacgtactacgtacggaaccggaaccgaccgggtacccgttaagttaacgtttccgttacggaccggacggaaacggtaacggtaaaaccggttaaaaaggtacggtaaacgggttaacggggttaacgggtttacccggggggaaacgtaaccggtaacggttaccggaaccgtaaccccggggg

SEQ ID NO: 440640 - DNA, 518 bp, Homo sapiens
  misc_feature: GZ8MTXP02G15EG.10.88.H11.1.454.CMB.2.raw
  modified_base (350)..(350): a, c, t, g, unknown or other
  modified_base (465)..(465): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtggtcagcgcttaccaagttggctacacaaattangcacagaagttccagggacagagtcaccatgacccacagacacatccacgagcacacgcctacataggaactggaggagcctagagatcgtgacgacgacggccgtatactttcngcgcgagacgacgtaaaagtgacgtggtagtccgggggacacgagtcgacacg

SEQ ID NO: 440641 - DNA, 528 bp, Homo sapiens
  misc_feature: GZ8MTXP02JIIWT.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgaggtgggtggggtgggtcaggcgcttaccaagttggctacacaaattntgcacagaacgttcaggacagagtcacatgaccacagacacatccacgagcacacgcctacataggaactggaggacgcctaggagatcgtacgacgacgaccggccgtatacgttctgcgacgagacgacgtaaaagtgacgtggtacgttcgggggacacgagtacgactaccgg

SEQ ID NO: 440642 - DNA, 517 bp, Homo sapiens
  misc_feature: GZ8MTXP02GJYYZ.10.88.H11.1.454.CMB.2.raw
  modified_base (281)..(281): a, c, t, g, unknown or other
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttaccgaagttggctacacaaattntgcacagaagttccaggacagagtcaccatcgaccacagacacatccacgagcacagcctacataggaactgaggagcctgagatctagacgacgacggccgtatattctgcgcgagagacgtaaagtgacgtggtagtaccgggggacacgagtacgacgtaccgg

SEQ ID NO: 440643 - DNA, 586 bp, Homo sapiens
  misc_feature: GZ8MTXP02HCQS0.10.88.H11.1.454.CMB.2.raw
  modified_base (355)..(355): a, c, t, g, unknown or other
  modified_base (398)..(398): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttggaggtggggtggggtggtcagcgcttacgaagttggctacgacaaattntgcacagaagttcaggacagagtcaccatgaccacagacacanccacgagcacacgcctaacagtaggaactaggacggacgccgtagacgatcgtacgaacgacgaaccggtaccgtattaactttcgtacggacggaccggaaaggaacggtaaaccggtaaaaggtacggtaacggtaagggttaacggttaccggggggaactaacgacgtacggaacgtaaccggg

SEQ ID NO: 440644 - DNA, 504 bp, Homo sapiens
  misc_feature: GZ8MTXP02FND75.10.88.H11.1.454.CMB.2.raw
  modified_base (364)..(364): a, c, t, g, unknown or other
  modified_base (471)..(471): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcatcctttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttggagtgggtggggtggtcagcgcttaccaagttggctacacaaattatgcacagaagttccnggacagagtcacatgaccacagacacatccacgagcacagctacatggaactgaggagctgagatctgacgacacggccgtatattctgcgcgagagacgtaaaagngacgtggtagtcgggggacacgatcgacaccgg

SEQ ID NO: 440645 - DNA, 598 bp, Homo sapiens
  misc_feature: GZ8MTXP02G29F5.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttcgtggttacacctttaacacctatggcatctccgtgggtgcgacacggcccctaggacaaggcttggaggtggggtggggtggtcagcgtacttaaccgagttggactaacgactaaatttngacaacgagtaacgttccagggtacaaggacgtaccaccatcgaacccacagacacactacacgagacacacgactacagtagaactagaggagcgtagagacgtacgacgaacgacgacggtacgtaacgttactttcgtacgtacggacggaagaacggaaacggtaaaagtcggtaacggtaagggttacggttaccgggggacacgtacgtacggaacgtaccggg

SEQ ID NO: 440646 - DNA, 508 bp, Homo sapiens
  misc_feature: GZ8MTXP02IYAEY.10.88.H11.1.454.CMB.2.raw
  modified_base (479)..(479): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttctccaggggacagagtcaccctctcctgtagggccagttatggtgttggcgcctatttaaactggtaccaacagaaacgtggccaggctcccaggctcctcatctacgaagcatccacagggccactggctcccagcccaggttcatggcagtgggctgggacagacttcactctcaccatccagcagcctggacgcctgaacgatattgactagtttattattgtacagcagcgtagcaggtgcctttcacgtttcggccgggacaagtgaaatcaaacgactgngctgcacatctgtcttcattctccgcatc

SEQ ID NO: 440647 - DNA, 514 bp, Homo sapiens
  misc_feature: GZ8MTXP02G68AL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtggtcagcgcttaccaagttggctacacaaattatgcacagaagttccaggacagagtcaccatgaccacagacacatcacgagcacagcctacatagaactagaggagcctgagatcgtgacgacacggaccgtatactttctgcgcgagagacgtaaagtgacgtggtacgtcgggggacacgacgtacgacacgg

SEQ ID NO: 440648 - DNA, 649 bp, Homo sapiens
  misc_feature: GZ8MTXP02G4J4E.10.88.H11.1.454.CMB.2.raw
  modified_base (344)..(344): a, c, t, g, unknown or other
  modified_base (348)..(348): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgaggtgggtggtggtcagcgcttacagttgctacacaatngcanagaagttcaggacagagtcacatcgaccacagacacactccacgagcacacgacctacaagtacggaaacgtaggaacgggacgacccgtaggaacgtaacgtaccgtacggaaccggaaccgaaccggggtacccgttaaacgttacgttttacgttacggaccggacgggtaaacggaaacgggtaaacggttaaaaaacgggtacgggtaaacgggttaacgggggttaaacgggtttaacccggggggggtaaaccgaaaccggtaacggttaacgggaacccgtaaaccccggggg

SEQ ID NO: 440649 - DNA, 602 bp, Homo sapiens
  misc_feature: GZ8MTXP02IXPEC.10.88.H11.1.454.CMB.2.raw
  modified_base (416)..(416): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctcctgggtgcgacacggcccctggacaaggacttgaggtggggtggggtggtcaggcgtcttaccgaaggttggctaacgaactaaattatgacacagtaacgttccagggacaagagtaccaccatcgaccacagacacacnccacgagacacagacctacatacggaactggaaggacgcctagaagactcgtagacgacgaccggaccgtaattacgtttcgtacggccgacggaaaggaaacggtaaaccggtaaaaggtacgtaacgggttaagggttaacggttaccggggggaacaacgacgtacggtaacgtaacccgggg

SEQ ID NO: 440650 - DNA, 638 bp, Homo sapiens
  misc_feature: GZ8MTXP02HXZXL.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtgcccactcccaggttcagctggtgcagtctggggctggaggtgaagagcccgtggggcctcagtgaagatctcctgcgaggtcttctggttacacctttaacacctatggctatctccgtgggtgcgacacggcccctggaccaaggtacttggaggtggggtggggtggtcaggcgtcttaaccgaaggttggactaacgaactaaattatcgacaacgagtaaacgttccaggggtacaaggtacgtaccaaccgtatacgaacccacaacgaacacactaccaacgacgaccaacacgacctaacacgtacggaacgtaggaacggacgaccgtaggacgtagtcgaggaacgacgtaccggtaccgtattacgtttacgtaggacggacggaaaggaaacgtaacggtaaaaggtcggtaacggtaaggttacgggttaccgggggactacgacgtacggaaccgtaccgggg

SEQ ID NO: 440651 - DNA, 650 bp, Homo sapiens
  misc_feature: GZ8MTXP02H0WDI.10.88.H11.1.454.CMB.2.raw
  modified_base (267)..(267): a, c, t, g, unknown or other
  modified_base (288)..(288): a, c, t, g, unknown or other
  modified_base (375)..(375): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcattccttttcttggtggcagcagcaacaggtcgcccactcccaggttcagctggtgcagtcgtggggctggaggtgaagagcccgtggggcctcagtgaagatctcctgcgaggtcttcgtggttacacctttaacncctatggcatctccgtgggtnccgacgacggcccctggacaaggtcgtttggaggtggggtggggtggtcaggcgtcttaaccgaggttcggactaacaactaaattntcgacaacgaaggtaacgttccgagggacaaggtacgtaccaacagtacgacccaacacgaacacactacccaacgacgaccaacacgacctacagtaacggaactaggacggtacgaccgtaggacgagtaccgtacgaacggacgaaccgggtaccgtaattacgtttaccgtggtacgtacggaaaggaaacggtaaacggtaaaaggtcggtaacggtaagggttacgggttaaccgggggaacacggtaacgtacgtaaccgtaccgggg

SEQ ID NO: 440652 - DNA, 566 bp, Homo sapiens
  misc_feature: GZ8MTXP02FPZ64.10.88.H11.1.454.CMB.2.raw
  modified_base (194)..(194): a, c, t, g, unknown or other
  modified_base (302)..(302): a, c, t, g, unknown or other
  modified_base (365)..(365): a, c, t, g, unknown or other
  modified_base (390)..(390): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctaatttaaactggtaaccaacagaaacgtggccaggctccagctcctcatcacgaancatccacaggccatggctcccagccaggtcgatggcagtggtcctgggacagacttcacttcncaccatcagcagcctgagctgaagntattgactagtttatattgacagtcagtcgtagctagggtcggtcctttacgacgtttccgggcccgggggtaaacaaagggtaggtaaaactacgaaaaaccgtacgtggtacgggcttacggacctaacctattacgtcgttacttaccgtacttcccgtacccgactactccg

SEQ ID NO: 440653 - DNA, 528 bp, Homo sapiens
  misc_feature: GZ8MTXP02JD8F1.10.88.H11.1.454.CMB.2.raw
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggcccctggacaaggcttgagtggggtgggtggtcagcgcttacaagttggctacacaaattntgacacagaagttccaggacagagtcaccatcgaccacagacacatccacgagcacagcctacataggaactggaggagccgtagagatcgtagacgacgacgacgtatattctgcgcgagacgaacgtaaacgtgacggtggtacgttaccgggggacacgacgtacgacgtaccgg

SEQ ID NO: 440654 - DNA, 514 bp, Homo sapiens
  misc_feature: GZ8MTXP02G6PIW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattatgcacagaagttccagggacagagtcaccgatgacccacagacacatccacgagcacagcctacatagactgaggagcgtgagatctgacgacgacggaccgtatattactgcgcgagacgacgtaaagtgacgtggtagtcgggggacacgatcgactacgg

SEQ ID NO: 440655 - DNA, 585 bp, Homo sapiens
  misc_feature: GZ8MTXP02GC0AR.10.88.H11.1.454.CMB.2.raw
  modified_base (281)..(281): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgaggtggggtggggtggtcagcgcttaccgaagttggctacacaaattatgcacagaagttcagggacagagtcaccatgaccacagacacactacacgagcacacgacctacataggaactagacggagccgtagagactctacgacgaacgaccggaccgttaattaacgtttacgtcgtaccggaccggaacggaaggtaaaccgttaaaaggtcggtaaccggtaaggggttaacggttaccggggggaacacggtacgtacggacgtaacccgggg

SEQ ID NO: 440656 - DNA, 517 bp, Homo sapiens
  misc_feature: GZ8MTXP02I7NNJ.10.88.H11.1.454.CMB.2.raw
  modified_base (281)..(281): a, c, t, g, unknown or other
  modified_base (347)..(347): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttaccagttgctacacaaattngcacagaacgttccaggacagagtcaccatgaccacagacacactccacgagcacacgacctacataggaactagaggagcctagagatcgtagacgacgacggacgtatatttctgcgcgagagacgtaaagtgagtggtagtacgggggacacgacgtcgacgtacgg

SEQ ID NO: 440657 - DNA, 632 bp, Homo sapiens
  misc_feature: GZ8MTXP02G1B55.10.88.H11.1.454.CMB.2.raw
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggcttctggttacacctttaacacctatggcatctccgtgggtcgcgacgcggcccctaggaccaaggacttggaggtggggtggggtggtcaggcgtcttaaccgaaggttggctaacaactaaattangacacaggtaacgttccgagggtaccaagtacgtaccaaccgtagtacgaacccaacgacgaaccacaactaccgaacgacgaccacacgacctacacgtaggaacgtaggacggacgaccgtagagtactcgtacggaccgaacgaccggtaccgtagttacgtttcgtacggacgacggaaggaacggtaaacgtaaaaggtacggtaacgggtaagggttacggttaccgggggactacgacgtacggacgtacccggg

SEQ ID NO: 440658 - DNA, 605 bp, Homo sapiens
  misc_feature: GZ8MTXP02IEMR7.10.88.H11.1.454.CMB.2.raw
  modified_base (281)..(281): a, c, t, g, unknown or other
  modified_base (368)..(368): a, c, t, g, unknown or other
tcagcatagtagtgcacgaccggtgctcgatttagcgacagcgagaacacacaaagggacccaaaaaccacaccctccttgggagaatccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggcttctggttacacctttaacacctatggcatctccgtgggtncgacacggcccctaggacaaggcttggaggtggggtggggtggtcaggcgtcttaaccgaaggttggactaacgaactaaaatttancggacaacgtaggtaaacgttccagggaaccaaggacgtaccaaccagtacgaaccaacgaacgacaacacaccaacgacgacaacacgacctacgagtacggaactaggaaggacgaccgtaggaagacgtacgagaaccgacgaccggaccgtaattacttcgtgcgacgaagaacgaacgtaaaagtcggaacggtggtacggttaccgggggacacgacgtacgacgaccggg

SEQ ID NO: 440659 - DNA, 514 bp, Homo sapiens
  misc_feature: GZ8MTXP02H3N5P.10.88.H11.1.454.CMB.2.raw
  modified_base (279)..(279): a, c, t, g, unknown or other
  modified_base (348)..(348): a, c, t, g, unknown or other
  modified_base (412)..(412): a, c, t, g, unknown or other
  modified_base (436)..(436): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttctggtggcagcagcaacaggtgcccactcccaggttcagctggtgcagtctgggctggaggtgaagagccctggggcctcagtgaagatctcctgcgaggcttctggttacacctttaacacctatggcatctcctgggtncgacaggcccctggacaaggacttgagtggggtggggtggtcagcgcttacaagttggctacacaaatntgcacagaagttccaggacagagtcacatgaccacagacacataccacgagacacagcctacanaggaactgaggagcctagagatcngacgacgacggacgtatattctagcgcgagagacgtaaagtgacgtggtacgttacgggggacacgatacgacaccgg

SEQ ID NO: 440660 - DNA, 525 bp, Homo sapiens
  misc_feature: GZ8MTXP02GBAMO.10.88.H11.1.454.CMB.2.raw
  modified_base (281)..(281): a, c, t, g, unknown or other
  modified_base (347)..(347): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtggggtggtcagcgcttacagttggctacacaattntgcacagaacgttccaggacagagtacaccatcgaccacagacacactaccacgagcacagcctacataggaactggaggacgcctaggagactcgtagacgacgacggaccgtattattctgcgcgagagacgtaaagtgacgtggtacgtacgggggacacgagtacgacgtacgg

SEQ ID NO: 440661 - DNA, 527 bp, Homo sapiens
  misc_feature: GZ8MTXP02GFSFL.10.88.H11.1.454.CMB.2.raw
  modified_base (193)..(193): a, c, t, g, unknown or other
  modified_base (254)..(254): a, c, t, g, unknown or other
  modified_base (388)..(388): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttcnccaggggacagagtcaccctctcctgtagggccagttatggtgttggcgcctatttaaacnggtaaccaacagaaacgtggccaggctcccaggctcctcatctacgaagcatccacaggccatggcgtcccagccaggttcgatggcaggtggtcctggggacagacttcactctcaccatcagcagcctggancctagaagatattgactagtttatattgtcagtcagcgtagcaggtggcctttcgacgtttcgggacccggggtaacaaaggtggaaaatcgaaaacgtactggtaggctagcaccatctgtctcatcctaccgcatcc

SEQ ID NO: 440662 - DNA, 555 bp, Homo sapiens
  misc_feature: GZ8MTXP02IE3DN.10.88.H11.1.454.CMB.2.raw
  modified_base (427)..(427): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctcctgggtgcgacaggcccctggacaaggacttgagtggggtggggtggtcagcgcttaccgaagttggactacactaaattatgcacagtaacgttccagggacagacgtccaaccatcgaccacagacacataccacgagcacagcctacanaggaactagaggagcctagagatacgtagacgacgacggaccgtagttactttctacgtcgacgaggaacgtacgtaaaagtagacggtaaggtacggtaccgggggacacgacgtacgacgtaccgg

SEQ ID NO: 440663 - DNA, 530 bp, Homo sapiens
  misc_feature: GZ8MTXP02IYCII.10.88.H11.1.454.CMB.2.raw
  modified_base (338)..(338): a, c, t, g, unknown or other
  modified_base (346)..(346): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttcgtggttacacctttaacacctatggcatctcctgggtgcgacaggcccctggacaaggcttgagtggggtgggtggcagcgctacaagtgctanacaattangcacagaagttccagggacagagtcgaccatagaccacagacacactaccacgagcacagcctacataggaactgaggagcctgaagactcagacgacgacgtacgtattattctgtacgcgaagagaacgtaaaagtcgtaggtaaggtacggtaccggggactacgagtacgacgtaccggg

SEQ ID NO: 440664 - DNA, 530 bp, Homo sapiens
  misc_feature: GZ8MTXP02ISCUM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggggtggggtggtcagcgcttaccaagttggctacactaaattatgacacagaacgttccagggacagagtccaaccatcgaccacagacacactccacgagcacacgacctacagtaggaactagaggagccgtagagatctagacgacgacggaccgtatattctgcgcgagagacgtaaagtgagtggtacgtacgggggacacgatcgacgtaccgg

SEQ ID NO: 440665 - DNA, 512 bp, Homo sapiens
  misc_feature: GZ8MTXP02GSDJH.10.88.H11.1.454.CMB.2.raw
  modified_base (281)..(281): a, c, t, g, unknown or other
  modified_base (349)..(349): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttggagtggggtggggtggtcagcgcttaccagttgctacacaatngcacagagttcaggacagagtcaccatcgaccacagacacatccacgagcacacgacctacagtagaactagaggagcctgagatcgtgacgacgacggccgtatatttctgcgcgagagacgtaaagtgacgtggtagtcggggacacgagtcgacgtacgg

SEQ ID NO: 440666 - DNA, 528 bp, Homo sapiens
  misc_feature: GZ8MTXP02H2XYJ.10.88.H11.1.454.CMB.2.raw
  modified_base (281)..(281): a, c, t, g, unknown or other
  modified_base (345)..(345): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggctttctggttacacctttaacacctatggcatctcctgggtncgacaggcccctggacaaggacttgaggtggggtggggtggtcagcgcttacgaagttggctanacaaattatgcacagaagttccaggacagacgtcaccatgaccacagacacactaccacgagacacacgacctacagtaggaactagaggagccgtagagatcgtagacgacgacggcgtatacttctgcgcgacgagacgtaaagtgacgtggtacgtacggggacacgagtcgacgaccgg

SEQ ID NO: 440667 - DNA, 570 bp, Homo sapiens
  misc_feature: GZ8MTXP02IZFZ9.10.88.H11.1.454.CMB.2.raw
  modified_base (348)..(348): a, c, t, g, unknown or other
tcagcatagtagtgcacgaccggtgctcgatttagcgacagcgagaacacacaaaggggacccaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctggtgcgacaggcccctggacaaggcttgagtgggtgggtggtcagcgcttaccagttggctacgacaaattangacacagaagttccaggacagagtcaccatcgaccacagacacactccacgagacacagacctacataggaactgaaggacgccgtagagagttcacggacgaacgaccggaccgtaagtaacgttttcctaggaccgacgaaggaaacggtaacggtaaaaagtcggaaacggttaagggtacggttaccgggggaacacggactacggacgtaacccggg

SEQ ID NO: 440668 - DNA, 600 bp, Homo sapiens
  misc_feature: GZ8MTXP02JU56I.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcaacaacaggtgcccactcccaggttcagctggtgcagtctggggctgaggtgaagagccctggggcctcagtgaagatctcctgcgaggcttctggttacacctttaacacctatggcatctccgtgggtgcgacacggcccctggacaaggacttggagtgggtgggtggtcagcgcttacgagttggctacacaattatgcacagagtccaggcagagtcacatcgaccacagacacataccacgagacacacgactacatacggaactaggaacggacgaccgtaggagactacgtacggacgaaccgaccggtaccggttaacttacgtttacgttacggacggaccggaaggaacggtaaaccggtaaaaggtacggtaacggtacggggttaacggttacccggggggaacgtaccgagtacggaccgtaccggtaccggggg

SEQ ID NO: 440669 - DNA, 608 bp, Homo sapiens
  misc_feature: GZ8MTXP02FXIWE.10.88.H11.1.454.CMB.2.raw
  modified_base (280)..(280): a, c, t, g, unknown or other
  modified_base (349)..(349): a, c, t, g, unknown or other
tcagcatagtagtgcacgaccggtgctcgatttagcgacagcgagaacacacaaaggggacccaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttcgtggttacacctttaacacctatggcatctcctgggtncgacgacggcccctggacaaggcttggaggtgggtggggtggtcagcgctacgagttgctacacaattntgacacgagtaacgttccagggacaagtagtaccaaccatacgaaccaacacgaacacaactaccgaacgacgaccaacacgacctaacagtacggaaactaggaacggacgaccgtaggaagactacgtacgaacgacgaccgggtaccgttaagttaacgtttcgtacggacgtacggaaacggtaacggtaaacggtaaaaggtcggtaacggtaaggtacggttaccgggggactacgagtacgacgtaaccggg

SEQ ID NO: 440670 - DNA, 513 bp, Homo sapiens
  misc_feature: GZ8MTXP02JWCFR.10.88.H11.1.454.CMB.2.raw
  modified_base (281)..(281): a, c, t, g, unknown or other
  modified_base (353)..(353): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttgaggtgggtggggtggtcagcgcttaccaagttggctacacaaattangcacagaagttcaggacagagtcaccatgaccacagacacatccacgagcacacgcctacataggaactgaggagcctgagatctgacgacacggccgtatacttctgcgcgagagacgtaaagtgacgtggtacgtacgggggacacgagtcgacacgg

SEQ ID NO: 440671 - DNA, 612 bp, Homo sapiens
  misc_feature: GZ8MTXP02JZS96.10.88.H11.1.454.CMB.2.raw
  modified_base (282)..(282): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggacttggaggtggggtggggtggtcaggcgcttaccgaaggttggctacactaaattatgcacagtaagttccaggacagagtcaccatcgaccacagacacactaccacgagacacacgacctacagtacggaaacgtaggaagggacgccgtagaagactcgtacggaaccgaacgaccggtaccgttagttaactttcgtacggcgacggtaaacggaacggtaaacggtaaaacggtacggtaacggttaaggggttaacgggttaccggggggacgtaacggtacgtacggaccgtaacccgggg

SEQ ID NO: 440672 - DNA, 523 bp, Homo sapiens
  misc_feature: GZ8MTXP02HOL6L.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggcccctggacaaggacttgagtggggtggggtgggtcaggcgcttaccgaagttggctacgacaaattatgcacagaagttccagggacagagtcaccatgaccacagacacatccacgagcacacgctacataggaactgaggtagctgagatctgacgacacggaccgtatatttctgcgcgagagacgtaaagtgacgtggtagttcgggggacacgacgtcgacgtaccgg

SEQ ID NO: 440673 - DNA, 521 bp, Homo sapiens
  misc_feature: GZ8MTXP02FWTOB.10.88.H11.1.454.CMB.2.raw
  modified_base (279)..(279): a, c, t, g, unknown or other
  modified_base (348)..(348): a, c, t, g, unknown or other
tcagcatagtagtgcacgaccggtgctcgatttagcgacagcgagaacacacaaaggggacccaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacacggcccctggacaaggcttgaggtgggtggggtggtcagcgcttacaagttgctacacaaattngcacagaagttccaggacagagtcaccatgaccacagacacatccacgagcacagcctacataggaactagaaggagacctagagatcgtagacgacgacggaccgtatatttctgcgcgagagaacgtaaaagtgacgtaaggtacgtacgggggacacgagtcgacaccgg

SEQ ID NO: 440674 - DNA, 560 bp, Homo sapiens
  misc_feature: GZ8MTXP02HV15L.10.88.H11.1.454.CMB.2.raw
  modified_base (207)..(207): a, c, t, g, unknown or other
  modified_base (261)..(261): a, c, t, g, unknown or other
  modified_base (282)..(282): a, c, t, g, unknown or other
  modified_base (410)..(410): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcagtgaagatctcctgcgaggcttctggttacacctttaanacctatggcatctcctgggtncgacaggcccctggacaaggcttggagtggggtggggtggtcagcgcttaccgaagttggactacgactaaattatgacaacagtaacgttccaggtacagacgtccaacatcgaccacagacacacncacgagacacacgacctacagtaggaactagaggagccgtagagactctagacgacgacggaccgtattactttcgagtcgacgagaagtaacgtaaaacgtgaacggtaaggttacggttaccgggggacacgagtacgaacgtaccgg

SEQ ID NO: 440675 - DNA, 527 bp, Homo sapiens
  misc_feature: GZ8MTXP02GEWVY.10.88.H11.1.454.CMB.2.raw
  modified_base (280)..(280): a, c, t, g, unknown or other
  modified_base (490)..(490): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttggagtggggtggggtggtcagcgcttaccaagttggctacacaaattatgcacagaagttccaggacagagtccaccatcgaccacagacacatccacgacgcacacgcctacataggaactagaggagccgtagagatctagacgacgacggaccgtatacttcgtgcgcgagacgacgtaaaagngacgtggtacgtcgggggacacgagtacgactaccgg

SEQ ID NO: 440676 - DNA, 614 bp, Homo sapiens
  misc_feature: GZ8MTXP02GLQBC.10.88.H11.1.454.CMB.2.raw
  modified_base (365)..(365): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcaacaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggacttggaggtggggtgggttggtcaggcgcttaccgaagtttggactacactaattactgcanagtaagttccaggcagagtcaccatcgaccacagacacactaccacgagacacagacctacacgtacggaaacgtggaacgggacgaccgtaggacggtactacgtacggaaccggaaccgaccgggtaccgttaattacgtttcgtcggaccggacggaaggtaaacggtaaacggttaaaaggtacggaacgggttaggtaacgggttaccgggggaactacgagtacggacgtaccggtacggggg

SEQ ID NO: 440677 - DNA, 673 bp, Homo sapiens
  misc_feature: GZ8MTXP02IFFI5.10.88.H11.1.454.CMB.2.raw
  modified_base (281)..(281): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctgagtgaagatctctgcgaggcttcgtggtacacctttaacactatggcatctccgtgggtncgacacggcccctaggacaggtacttggaggtggggtggggtggtcgaggcgtcttaaccgaaggttggactaacgaactaaaattagtgacctaacgaaggtaaacgttacccgagggtaaccaaggtaacgttaccaaccctagtaccgaacccaacaacgaaccaacactaccaacgacgaccaacacgacctacatacggaacgtaggaaggacgccgtaggaagtagtacgtacgaacgaaccggaaccggtaccgtaacgttaacgtttaccgtacggtaccggacgtaacggaaacggtaaaaccggtaaaaacggtacggtaacggttaagggttaacggttaaccgggggtacaacggtaacgtacggtaaccgtaacccggg

SEQ ID NO: 440678 - DNA, 559 bp, Homo sapiens
  misc_feature: GZ8MTXP02F49KZ.10.88.H11.1.454.CMB.2.raw
  modified_base (354)..(354): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttggaggtggggtggggtggtcagcgcttaccgagttggctacacaaattngcacagaacgttcagggacagagtcaccatcgaccacagacacataccacgacgcacacgacctacataggaactaggaggacgccgtagagactcgtagacgacgacggaccgtattactttcgtcggcgacgaaggacgtaacgtaaaagtaggtacggtaagggtacggttaccgggggacacgtacgtacgacgtaccggg

SEQ ID NO: 440679 - DNA, 573 bp, Homo sapiens
  misc_feature: GZ8MTXP02JMEEL.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtggggtggggtggtcaggcgtcttaccgaaggttggactacacaaattatgacacagaagttccaggacagagtcatcgatcgaccacagacacactaccgacgacgacacacgacctacagtaggaactggaggacgccgtagagatcgtacgacgacgacggaccgttattacgtttcgtcgacggacgtaacggagtaaacggtaaaagtacggtaacggtagggtaacggttaccgggggactaacgacgtacgaaccgg

SEQ ID NO: 440680 - DNA, 616 bp, Homo sapiens
  misc_feature: GZ8MTXP02IZWL2.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttggaggtggggtggttggtcaggcgtcttaccaggttggactacacaaattngcacagaattccagggacagacgtacaccatcgaccacagacacactaccacgacgacacacgacctacagtacggaaaccgtaggaacgggacgacccgtaggaagtacgtacgtacgaaccggaccgaccggtacccgtaagttaactttccgtacggaccggaccggaaggaaacggtaaaccggtaaaaggtacggtaacggtaacgggttaacgggttaccgggggacaaccgtacgtacggaccgtacccgggg

SEQ ID NO: 440681 - DNA, 597 bp, Homo sapiens
  misc_feature: GZ8MTXP02GQ1QT.10.88.H11.1.454.CMB.2.raw
  modified_base (194)..(194): a, c, t, g, unknown or other
  modified_base (257)..(257): a, c, t, g, unknown or other
  modified_base (305)..(305): a, c, t, g, unknown or other
  modified_base (393)..(393): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgccttaatttaaacnggtaaccaacagaaacgtggccaggctcccaggctcctcatcacgaancatccaccagggccactggctcccagcccaggttcgatggcaggtggtcctggggacagacttcactctcaccatcagcagcctggancctagaagatattgactagtttatattgcagcagcgtagcagggtcgtcctttcgacgtttccggggacccggggaactaaaggttcggaaaacttccgaaaaacggtaacgttgggtacgggtacctacggaccctaacccgtagtttccttcggtttaccttacctacgtttcccctttacccccggaccttaactttcccg

SEQ ID NO: 440682 - DNA, 527 bp, Homo sapiens
  misc_feature: GZ8MTXP02FWV4Y.10.88.H11.1.454.CMB.2.raw
  modified_base (477)..(477): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggccccctggacaaggacttgaggtggggtggggtgggtcagcgcttaccgagttggctacacaaattatgacacagaagttaccgaggacagagtccaccatcgaccacagacacactaccacgacgcacacgcctacataggaactggaggacgccgtagagatctagacgacacggacgtatattcngcgcgagagacgtaaagtgacgtgtacgtcggggacacgatcgactacgg

SEQ ID NO: 440683 - DNA, 571 bp, Homo sapiens
  misc_feature: GZ8MTXP02GKBTJ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgaggtggggtggggtgggtcagcgcttaccaagttggctacgacaaattatgcacagagttccgaggacagagtcaccatgacccacagacacactacacgagcacacgcctacataggaactaggaggagcctagagatcgtagaccgaacgacggacgtacgttaactttcgtagtccggacggaagaacggaaccggtaaaaggtacgtaacggtaagggttacggttaccggggggacacgacgtacggacctaacccgggg

SEQ ID NO: 440684 - DNA, 545 bp, Homo sapiens
  misc_feature: GZ8MTXP02JQ0HL.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctcctgggtgcgacaggcccctggacaggacttgagtgggtgggtggtcagcgcttaccaagttggctacacaaattangcacagaagttcaggacagacgtcacatcgaccacagacacactaccaacgagacacacgacctacataggaaacctaggaggagaccgtagacgatcgtaggacgacgacggaccgtagtactttctgacgccgaagacgaacgtaaaacggtcgagtggtacgttaccgggggacacgacgtcgacaaccgg

SEQ ID NO: 440685 - DNA, 558 bp, Homo sapiens
  misc_feature: GZ8MTXP02GE74T.10.88.H11.1.454.CMB.2.raw
  modified_base (358)..(358): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggccccctggacaaggacttggaggtggggtggggtggtcaggcgcttaccgaagttgctacacaaattngcacagaagttccaggacagagtcaccatcgaccacagacacactaccacgagacacacgcctacacgtaggaactggaggacgccgtaggagagtcgtagacgaacgacggtaccgtattactttcgtcgacgacggaggaacgaacgtaaagtgacggtaaggtacggtacgggggacacgacgtacgacgtaccggg

SEQ ID NO: 440686 - DNA, 557 bp, Homo sapiens
  misc_feature: GZ8MTXP02HSZHF.10.88.H11.1.454.CMB.2.raw
  modified_base (282)..(282): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggacttgaggtgggtggggtggtcagcgtcttaccaagttgctacactaaattangacacagtaacgttccagggacagagtccaccatgacccacagacacactccacgagacacacgacctacataggaactgaggagacctgagatctagacgacgacggaccgtatacgtttactgtcgcgagaacgtacggtaaaacgtagaacggtaaggttaacggttaccgggggaacacgacgtacgacgtaaccgg

SEQ ID NO: 440687 - DNA, 623 bp, Homo sapiens
  misc_feature: GZ8MTXP02GPABB.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtcgcgacacggcccctggacaaggcttgaggtggggtggggtggtcagcgcttaccgagttcggctacacaaattatgacacagaagttccagggacagagtcaccatcgaccacagacacactaccacgagacacacgacctacagtacggaaacgtaggaacggagaccgtaggaacgacgtacgtacggaacgacgaaccggtaccgtaacgttaacgtttcgtacggtaccggacggaacggaacggtaaaccggttaaaaaggtacggtaacgggtaacggggttaacggtttacccggggggaacgtaaccgtaacgtacggaaccgtaacccgggg

SEQ ID NO: 440688 - DNA, 678 bp, Homo sapiens
  misc_feature: GZ8MTXP02FPKYZ.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagcgccgtggggcctcgagtgaagatctcctgcgaggtcttctggttactaccttaacacctatggcatctccgtgggtcgcgacgacggtcccctggacgaaggtcgttggaggtggggtggggtcggtacacggtccgtacgttaaccgtaaaggtttcggacctaacgaacgtaaaatttagtcgacaacgtaagtaacggtttacccgagggaaccaaggtacgtaccaacccgtagtacgaacccaacgacgtaaccacgactaccgaacgacgacacgacgacctaacagtacgtaacgaggaacggacgtccgtaggacgtacgtacgtacggaacgaccgaccggtacgttagttacgtttcgacggacggacggtaaacgaaacggtaaacggttaaaacggtcggtaacggtaagggttacgggttaccgggggaactacgtacggtaccggacgtaacccgggg

SEQ ID NO: 440689 - DNA, 683 bp, Homo sapiens
  misc_feature: GZ8MTXP02FE7OY.10.88.H11.1.454.CMB.2.raw
  modified_base (274)..(274): a, c, t, g, unknown or other
  modified_base (292)..(292): a, c, t, g, unknown or other
  modified_base (426)..(426): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatcctttctggtggcagcagcaacaggtcgcccactcccaggttcagctggtgcagtcgtgggctgaggtgaagcgcccgtggggcctcgagtgaagctctccgtgcgaggtcttcgtacggttacctacctttaacacctagnggctatcctcggtgggcncgacgacggtcccctaggaccgtaaggtcttgggaggttggggttaggggttcggtcaggccgtaccgttaacgtaaaggttcgactaactaactaaacgttgcgacacgaagtacgttacgaggacaggtacnccacctagacgaaccaacacgaaccactaacaccgaacgacaccaacgtaaccgacctaaacgagtaacggaacgacgggacggtaacgccgttaggacgacgttcgtacgaacgacgtaccggaccgtttatacgttcgtacggacggtaaccggaaggaaacggtaaaaccggtaaaggtaccggtaacggggttaacgggtaaaccggggttaccgggggaacacggtaacggaccggaccggtaaccccgggg

SEQ ID NO: 440690 - DNA, 545 bp, Homo sapiens
  misc_feature: GZ8MTXP02GT2AE.10.88.H11.1.454.CMB.2.raw
  modified_base (282)..(282): a, c, t, g, unknown or other
  modified_base (352)..(352): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggacttgaggtggggtgggtggtcagcgtcttacagttgctacacaattangcacagaacgttccaggacagagtcaccatcgaccacagacacactaccacgacgcacacgacctacataggaactggaggagctagagactctagacgacgacggaccgtatacgtttctgcgcgagaacgtaacgtaaaagtacggtacggtaaggtacggtaccgggggacacgagtacgacgtaccggg

SEQ ID NO: 440691 - DNA, 531 bp, Homo sapiens
  misc_feature: GZ8MTXP02GBNCL.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtgggtggggtggtcaggcgcttacagttggctacacaaattntgcacagaagttccaggacagagtcaccatcgaccacagacacactaccaacgacgcaacacgacctaacataggaactggaggagcctagagactcgtagacgacgacggtaccgtattacttctgcgacgagagacgtaaagtgacgtggtacgtacgggggacacgagtagacacgg

SEQ ID NO: 440692 - DNA, 521 bp, Homo sapiens
  misc_feature: GZ8MTXP02FVPFH.10.88.H11.1.454.CMB.2.raw
  modified_base (487)..(487): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgaggtggggtggggtggtcagcgcttaccagttgctacacaaattatgacacagaacgttccagggacagagtcaccatcgaccacagacacactccacgacgcacacgcctacataggaactgaggacgcctagagatctagacgacacggccgtatacttctgcgcgagagacgtaaagngacgtggtacgtcggggacacgagtcgacgacgg

SEQ ID NO: 440693 - DNA, 616 bp, Homo sapiens
  misc_feature: GZ8MTXP02HGN92.10.88.H11.1.454.CMB.2.raw
  modified_base (262)..(262): a, c, t, g, unknown or other
  modified_base (284)..(284): a, c, t, g, unknown or other
  modified_base (363)..(363): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtctggggctgaggtgaagagcccgtggggcctcagtgaagatctcctgcgaggcttctggttacacctttaanacctatggcatctccgtgggtncgacaccggccctaggacaaggcttggaggtggggtggggtggtcaggcgtcttaccgaagttggactacacaaattangacaacagtaacgttccgaggtacagacgtaccaacctatacgaacccaacaacgaaccaacaactacccgaacgacgaccgaacaacgacctacaagtaaggtaaaccgtaggaacggacgaccgtaggaagactcgtacggaacgacgaccggaccgtacttacgtttctggcgacgaaggaacggaaacgtaaaaggtaggtacggtaaggtacggttaccgggggacacgacgtacggaccgtaccggg

SEQ ID NO: 440694 - DNA, 585 bp, Homo sapiens
  misc_feature: GZ8MTXP02JX1AO.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccccgtagaacgagtcgtggtgggtggggtgggtcggcgcggcgtacctagtaggtcgactaacgaataatgcacaagacgtacgtacgacgagacgtacgaccatacgaccacacgacacactaccacgacgacacacgacctacagaggaacgtacgaggacgacgtgaggactagtccgacgaaccgacgccggttactattcgtcggtcgacggacgaaaggaacgtaaacgtaacggtacgtacgggtaacggttaccggggacggacacgtacgtacgacgtacgggg

SEQ ID NO: 440695 - DNA, 616 bp, Homo sapiens
  misc_feature: GZ8MTXP02HSX9M.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctctgcgaggcttctggttacacctttaacacctatggcatctccgtgggtgcgacacggcccctggacaaggacttggaggtggggtggggtggtcaggcgcttaaccgaagttcggactacgaactaaaattatcgacaacgagaaacgttccagggacaagacgtaccaaccatacgaacccaacaacgacaactacacccaacgacgacaacacgaccctacagtaggaaactaggaaggacgaccgtaggaagattacgacggaacggacgaccggtaccgttataacgtttcgacgacggacgaaggaaggtaaacgtaaaaggtcggtaacgggtaagggtacggttaccgggggacacgacgtacggaaccgaccggg

SEQ ID NO: 440696 - DNA, 520 bp, Homo sapiens
  misc_feature: GZ8MTXP02JLC7J.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggttggtcagcgcttaccaagttggctacacaaattatgcacagaagttccaggacagagtcaccatgaccacagacacatccacgagcacagcctacataggaactgaggagcctgagatctagacgacgacggaccgtatattctgcgacgagacgacgtaaaagtgacgtggtacgttaccgggggacacgagtcgacgtaccgg

SEQ ID NO: 440697 - DNA, 623 bp, Homo sapiens
  misc_feature: GZ8MTXP02H7IE5.10.88.H11.1.454.CMB.2.raw
  modified_base (284)..(284): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggcttctggttacacctttaacacctatggcatctcctgggtncgacaggcccctggacaaggcttggaggtggggtggggtggtcaggcgcttaccgaaggttggactacactaaattatgacacagtaacgttccaggggacaggacgtccaaccgatacgacccaacaagaccaacactaccaacgacgcaacacgacctacagtaggaactaggacggacgccgtgaagagtcgtaggacgaaccgacggaccgtagttaactttcgtgaccggacgaaacggaacggtaaacggtaaaaacggtggtaacgggttaacgggttaacggggtttacccggggggaacctaacgtaacgtacggaaccgtaacccgggg

SEQ ID NO: 440698 - DNA, 661 bp, Homo sapiens
  misc_feature: GZ8MTXP02IZEAS.10.88.H11.1.454.CMB.2.raw
  modified_base (220)..(220): a, c, t, g, unknown or other
  modified_base (237)..(237): a, c, t, g, unknown or other
  modified_base (375)..(375): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtcgtggggctgaggtgaagagcccgtgggcctnagtgaagatctctgcgngtcttcgtgttactacttacacctatgcatctccgtgggtgcgacgacggcccctaggacaaggtacttggaggtggggtggggttggtcgaggtccgtactttacccgaaggttcggactaacgaactaaaatttanacgtacaacgtagtaaacgtttcccgagggtacaaggacgtaccaaccctagtacgacccaacgagaaccacaactaccgacgaacgccaacacgaccctaacagtacggtaaacgtaggaagggtacgcccgtaggaacgacgttacgacgacggaacccgacggtaccgtaattaactttcgcggacgaccggaaggtaaacggtaacggtaaaaaggtcggtaacggttaacgggtacgggtttaccgggggaacgaaccgtagttacgaaccgtaaccgggg

SEQ ID NO: 440699 - DNA, 574 bp, Homo sapiens
  misc_feature: GZ8MTXP02F64U9.10.88.H11.1.454.CMB.2.raw
  modified_base (281)..(281): a, c, t, g, unknown or other
  modified_base (352)..(352): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacactttaacacctatggcatctccgtgggtncgacacggcccctggacaaggcttggagtggggtgggtggcagcgcttaccgaagttggctacacaaattngcanagtaagttcaggacagacgtcaccatcgaccacagacacataccacgagcacacgacctacagtaggaactaggaggagccgtagacgagtcgtacggaacgaaccgacggtaccggtaattactttacgtagcgacggaaggaacggtaaacgtaaaacggtggtaacggtaaggttacgggttaccgggggacaccgtagtacggacgtaccgggg

SEQ ID NO: 440700 - DNA, 510 bp, Homo sapiens
  misc_feature: GZ8MTXP02JCBC3.10.88.H11.1.454.CMB.2.raw
  modified_base (338)..(338): a, c, t, g, unknown or other
  modified_base (345)..(345): a, c, t, g, unknown or other
  modified_base (389)..(389): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgagtgggtggtggtcagcgcttacagttgctanacaattngcacagaagttccaggacagagtcaccatcgaccacagacacanccacgagcacacgacctacataggaactagaggagcctagagatctagacgacacggcgtatattctgcgcgagagacgtaaagtgagtggtacgtacgggggacacgagtacgacaccgg

SEQ ID NO: 440701 - DNA, 530 bp, Homo sapiens
  misc_feature: GZ8MTXP02JKXBJ.10.88.H11.1.454.CMB.2.raw
  modified_base (281)..(281): a, c, t, g, unknown or other
  modified_base (465)..(465): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtggggtggtcagcgcttaccaagttggctacactaaattatgcacagaacgttccaggacaggagtcacatcgacacagacacatccacgagacacacgcctacagtaggaactaggaggacgctagagatcagacgacacggcgtatatttcngtcgacgagacgaacgtaaaagtcgaacgtggtacggttaccgggggacacgagtacgacaccgg

SEQ ID NO: 440702 - DNA, 578 bp, Homo sapiens
  misc_feature: GZ8MTXP02JHB21.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacgacggcccctaggacaaggcttggaggtggggtgggtggtcagcgtcttaccgaagttgactacacaaattngcacagaacgttcagggacagacgtcaccatgaccacagacacatccacgagacacacgacctacagtaggactaggacggagaccaggagagtcacggacgacgaccggtacgttatacgtttcgtcggacggacgaaggaacgaaacgttaaaaggtcggtaacgggtaacgggtacgggttacccgggggaacacgtaacgtacggacgtaacccgggg

SEQ ID NO: 440703 - DNA, 541 bp, Homo sapiens
  misc_feature: GZ8MTXP02G6TXP.10.88.H11.1.454.CMB.2.raw
  modified_base (282)..(282): a, c, t, g, unknown or other
  modified_base (359)..(359): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggacttggaggtggggtggggtggtcaggcgcttaccgaagttggactacacaaattntgcacagaagttccaggacagagtcaccatgaccacagacacactccacgagacacacgacctacatagaactgaggagctgagatctagacgacgacggaccgtagtattctgcgcgagaacgaacgtaaaagtgtacgtaaggtacggttaccgggggacacgacgtacgacgtaccggg

SEQ ID NO: 440704 - DNA, 513 bp, Homo sapiens
  misc_feature: GZ8MTXP02I856D.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaggacttgagtgggtggggtggtcagcgcttaccaagttggctacgacaaattntgcacagaagttccagggacaggagtcaccatgaccacagacacatccacgagcacagcctacatggaactgaggagcctgagatctgacgacacggaccgtatattctgcgcgagagacgtaaaagtgacgtggtagttacgggggacacgatgacaccgg

SEQ ID NO: 440705 - DNA, 552 bp, Homo sapiens
  misc_feature: GZ8MTXP02FLYFN.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggaccaaggcttggaggtggggtggggtggtcagcgcttaccgaagttggctacgacaaattatgcacgagaagttccagggacagagtcacatcgacacagacacatcacgagacacacgacctacagtaggaactaggaggagaccgtaggagatcgtagacgacgaccggaccgtagtatttcgtcgcgacgaagaacgaacgtaaaagtagacggtaaggtacggttacgggggacacgagtacgacgtaccgg

SEQ ID NO: 440706 - DNA, 606 bp, Homo sapiens
  misc_feature: GZ8MTXP02JVY49.10.88.H11.1.454.CMB.2.raw
  modified_base (291)..(291): a, c, t, g, unknown or other
  modified_base (431)..(431): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtgggggcctcgagtgaagatctcctgcgaggtcttcgtggttacacctttaacacctatcggcatcctccgtgggtcncgacgacggcccctaggacaaggcgttggaggtggggtggggtggtcgagcgacttacgaggttgctacactaaatgtgacacgagtaacgttccagggacaggactcacagtcgaaccacacgacacactccaacgacncaacacgacctacagtacggactaggacggacgcctggagactacgtacgaacggacgtaaccggaccgttagtaactttcgtacggacgacgtaaggaacggtaaacggtaaaaggtcgggtacggttaaggtacgggtaccgggggacaccgtacgtacggaacgtacccggg

SEQ ID NO: 440707 - DNA, 566 bp, Homo sapiens
  misc_feature: GZ8MTXP02G4VCA.10.88.H11.1.454.CMB.2.raw
  modified_base (291)..(291): a, c, t, g, unknown or other
  modified_base (370)..(370): a, c, t, g, unknown or other
  modified_base (406)..(406): a, c, t, g, unknown or other
  modified_base (422)..(422): a, c, t, g, unknown or other
  modified_base (434)..(434): a, c, t, g, unknown or other
  modified_base (438)..(438): a, c, t, g, unknown or other
  modified_base (494)..(494): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggtcttcgtggttacacctttaacgaccctagtggcatcctccgtgggtncgacacggcccctggaccaaggcttgaggtggggtggggtggtcaggcgcttacgaagttcggactacgactaaattancgacaacagtaacgttccagggacagacgtcactancgaccacagacacacncacgagcacacnctanatagaactgagacgactagagactcgacgacgacgacggtaccgtattacgtttcncgacgacgaggaagtaacgtaaaggtcgtacggtggtacggttaccgggggactagacgtacgacgaccggg

SEQ ID NO: 440708 - DNA, 614 bp, Homo sapiens
  misc_feature: GZ8MTXP02GBZOR.10.88.H11.1.454.CMB.2.raw
  modified_base (281)..(281): a, c, t, g, unknown or other
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacacggcccctggacaaggcttggagtggggtggggtggtcagcccttacagttggctacacaaattntgcacagaagttccaggcagagtcaccatcgaccacacgacacactaccacgacgacacacgaccctacacgtacggaaacgtaggaaggacggaccgtagacgataccgtaggaaccgaccgacgggtacccgttagttacgtttcgtacggccggacggaacggtaaacggaaacggttaaaacggtacggtaacgggttacgggttaacgggtttacccggggggaacaccgtagtacggaaccgtaccggtaccggggg

SEQ ID NO: 440709 - DNA, 592 bp, Homo sapiens
  misc_feature: GZ8MTXP02GY8EM.10.88.H11.1.454.CMB.2.raw
  modified_base (194)..(194): a, c, t, g, unknown or other
  modified_base (531)..(531): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtccaccctctcctgtagggccagttatggtgttggcgccttatttaaactggtaccaacagaaacgtggccaggctcccaggctcctcatctacgagcatcccaccacgggccacgtggccgtcccagcccaggttcgatggcaggtgggtcctggggacaggtacttcactctccaccatcagcagcctggactctagaagatagttgacttagtttattagttgactagcgtagtcgtaagcgtagggttcgtcctttccgacgtttccggggacccggggtaacaagggttacgaaaatcgaaaacgtacgttggtacggnttacggacctacctattaccgttgtccctttacacttcccgtttaccccgcctaattcccg

SEQ ID NO: 440710 - DNA, 623 bp, Homo sapiens
  misc_feature: GZ8MTXP02FU3VT.10.88.H11.1.454.CMB.2.raw
  modified_base (326)..(326): a, c, t, g, unknown or other
  modified_base (364)..(364): a, c, t, g, unknown or other
  modified_base (389)..(389): a, c, t, g, unknown or other
  modified_base (400)..(400): a, c, t, g, unknown or other
  modified_base (518)..(518): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaaacaggtgcccactcccacggttcagctggtgcagtctggggcgtgaggtggaagagccctggggcctcagtgaagatctcctgcgaggcttctggttacacctttaacacctatggcatctcctgggtgcgacacggcccctggacaaggacttggaggtggggtggggnggtcagcgtccttacgaagttggctaacacaaatttangcaacaagtacttccagggacaagngtccaccagtnacccacagacacataccacgacgacacaacgcctaaaccagtacggtaaccagaagggacgccgttacggaagaactcgtacgaccggtaacgaccggtaccggtactattttaccgnggtaccggcggaaaggaacgtaacggttaaaaagtcggaaacgggtttaacgggttacggggttacccgggggaacaccgtacgtacggaccggtaaaccccggg

SEQ ID NO: 440711 - DNA, 517 bp, Homo sapiens
  misc_feature: GZ8MTXP02FH4YA.10.88.H11.1.454.CMB.2.raw
  modified_base (369)..(369): a, c, t, g, unknown or other
  modified_base (403)..(403): a, c, t, g, unknown or other
  modified_base (436)..(436): a, c, t, g, unknown or other
  modified_base (506)..(506): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtgcgacaggcccctggacaaggacttgagtgggtggggtgggtcagcgcttaccaagttggctacacaaacttatgcacagaagttccnggacagagtcaccatgacacagacacatccagancacagcctacatggaactgagagcctgagatcngacgacacggccgtactattctgcgcgagagacgtaaaacgtagacgtggtagttacgggggacggacanacgacacccgg

SEQ ID NO: 440712 - DNA, 665 bp, Homo sapiens
  misc_feature: GZ8MTXP02JFZJN.10.88.H11.1.454.CMB.2.raw
  modified_base (449)..(449): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctggaggtgaagagccctggggcctcgagtgaagatctcctgcgaggcttctggttacacctttaacacctatggcatctccgtgggtcgcgacacggcccctggacaaggcttggaggtggggtggggtggtcgaggcgtcttaaccgaaggtttcggactaacgactaaaatttatcggacaactaaggtaacgttacccgagggtacaaggacgtacaaccatcgaacccacagacacacgtaccaacgacnccgacacgacctacgacgtacggaaccgtaggaacgggacgacccgttaggaacgtacgtacgtacggaaccggacgaccggtaccgtaacttacgtttacgtcggacggaccggaaaggtaaacggtaaacggttaaaacggtacggtaacgggttaaggggttaacggttaacccggggggactaacgtaacggtacggaaccgtaacccgggg

SEQ ID NO: 440713 - DNA, 664 bp, Homo sapiens
  misc_feature: GZ8MTXP02J01X6.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctgaggtgaagagcccgtggggcctcagtgaagatctcctgcgaggtcttctggttaccacctttaacacctatggcatctccgtgggtgcgacacggcccctggacaaggcttgaggtgggtggggtggcgagcgcttaccgaaggttggactaacactaaattatgactacgagtaacgttccagggacagagtacacatcgaaccacagacacactacacgagacacgacgacctacacgtacggaaactaggaacgggacgaccgttaggaacgtacgtacgtacggaaccggaaaccgaccgggtaccgttaacgtttacgtttaccgtacggtaccggacggtaaacggaaacgggtaaaacggtaaaaacgggttacgggtaaccggggttaaggggttaaccgggggtttaccgggggggaaactaaccggtacgttaaccggaacccggtaacccggggg

SEQ ID NO: 440714 - DNA, 583 bp, Homo sapiens
  misc_feature: GZ8MTXP02JNOBC.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttcgtggttactacctttaacacctatggcatctccgtgggtgcgacgacggcccctaggacaaggcttggaggtggggtgggtggtcagcgtctacgaagttgctacactaattatgacacagaacgttcgaggacagacgtacaccatcgacccaacacgacacactacccaacgacgccaacacgacctacagttacggaaaccttaggaacgtccgtagacgtatacgacgacgacgacgtacgtatacttcgtgacgacgaagaaggtaacgtaaagtcggacggttaggtaacgggtacgggggaacacgtacgtacggaccgaacggtcgggg

SEQ ID NO: 440715 - DNA, 631 bp, Homo sapiens
  misc_feature: GZ8MTXP02ISSDR.10.88.H11.1.454.CMB.2.raw
  modified_base (210)..(210): a, c, t, g, unknown or other
  modified_base (290)..(290): a, c, t, g, unknown or other
  modified_base (382)..(382): a, c, t, g, unknown or other
  modified_base (389)..(389): a, c, t, g, unknown or other
  modified_base (428)..(428): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagngcccgtggggcctcgagtgaagatctcctgcgaggtcttcgtggttactacctttaacacctatggcatctccgtgggtncgacacggcccctaggacaaggctttggaggttggggtggggtggtcgaggccgtcgttaaccgaaggttggactaacgaactaaatttagngaccaanaaggtaacgtttccgagggacaaggacgtaccaacctanacgaccaacacgaacacacaccgaacgacgaccaacacgacctacaagtaggaactggaaggacgccgtagagtactcgagacgacgaccggtaccgtattacgtttacgcggaccgacggaagtaacggtaaacgtaaaacggtcggtaacggtaacggttacgggtaccgggggacaacgtacgtacgaaccgtaccgggg

SEQ ID NO: 440716 - DNA, 566 bp, Homo sapiens
  misc_feature: GZ8MTXP02GI70P.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccctggacaaggcttggaggtggggtggggtggtcagcgcttacgaagttgactacactaaattangacacagaagttccaggacaggacgtcaccgatacgaaccacagacacaactaccaacgagacaacacgacctacagtaggaaactaggaaggagccgtagagacgtcgtacgacgaacgaccggaccgtatactttcgtcgacgcgaacgagaacgtaaaacgtgaacggtaaggtacggttaccgggggacacgagtacgacgaccgg

SEQ ID NO: 440717 - DNA, 566 bp, Homo sapiens
  misc_feature: GZ8MTXP02JWDSR.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgaggtgggtggggtggtcaggcgcttaccaagttggctacacaaattatgacacagaagttccaggacagacgtcaccatacgaccacagacacatccagacgcacacgcctacagtacggaactgaggagccgtagagatcgtaggacgacacggtacccgtagttaactttcgtgcgacggaagacggtaaccgtaaaaggtcggtaaggtaacggttacggttaccgggggactaacgacgtacggaacgtacccgggg

SEQ ID NO: 440718 - DNA, 562 bp, Homo sapiens
  misc_feature: GZ8MTXP02HBD5M.10.88.H11.1.454.CMB.2.raw
  modified_base (221)..(221): a, c, t, g, unknown or other
  modified_base (364)..(364): a, c, t, g, unknown or other
  modified_base (372)..(372): a, c, t, g, unknown or other
  modified_base (377)..(377): a, c, t, g, unknown or other
  modified_base (424)..(424): a, c, t, g, unknown or other
  modified_base (432)..(432): a, c, t, g, unknown or other
  modified_base (446)..(446): a, c, t, g, unknown or other
  modified_base (465)..(465): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctnagtgaagatctcctgcgaggcttcgtggttacacctttaacacctatggcagtctccgtgggtcgcgacacggcccctaggaacaaggaattggaggtggggtggggtggtcagcgtacttaaccgaagttggactaacgaanaaaatttngacanaagaacgttcaggacagactaccaacatacgaaccacaagacacacnccaacgancaacagacctaganagaactgagagctaggaanatcgacgacgacgaccgtacgtatattcgtcgcgacgagaacgaacgtaaacgtggacggtggtacgggtaccggggacaacgacgtacgacgacgg

SEQ ID NO: 440719 - DNA, 560 bp, Homo sapiens
  misc_feature: GZ8MTXP02HCHGO.10.88.H11.1.454.CMB.2.raw
  modified_base (281)..(281): a, c, t, g, unknown or other
  modified_base (355)..(355): a, c, t, g, unknown or other
  modified_base (429)..(429): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtttggggctgaggtgaagagcctggggcctcgagtgaagatctcctgcgaggcttctggttacacctttaacacctatggcatctcctgggtncgacacggcccctggacaaggcttggaggtggggtggggtggtcaggcgcttacgaagttggactacactaatntgacacagtacgttccaaggacagacgtcaccatacgaccacaacgacacactccacgagacacacgaccctanacgtaggaaactgaacggacgccgtaggagatcgtacgacgaacgacggtaccgtattacttcgtcgcgcgagagaacgtaaagcgtaacgtggtaacggtcggggactacgagtacgacgacggtcgggg

SEQ ID NO: 440720 - DNA, 703 bp, Homo sapiens
  misc_feature: GZ8MTXP02GIAVR.10.88.H11.1.454.CMB.2.raw
  modified_base (288)..(288): a, c, t, g, unknown or other
  modified_base (293)..(293): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcgagtgaagatctcctgcgaggtcttctggttacacctttaacacctatggcatctccgtgggtncgacncggcccctggacgaggacttggaggtggggtggggtggtcaggcgtcttaccgaaggttggactaacaactaaattagtcgactaacgaaggtaacgttccgagggacaaggtacgtaccaaccgagtacgaacccaacgaacgaaccacaactaccaacgacgaccaacgacgacctaacagtacggaaacgtaggaacgggacgccgtaggaacgtacgtacgtacggaccgaaccgaccggggtacccgttaagttacgttttaccgttcggaccggacggaaacgggtaaacggtaaaaccgggttaaaaacggttacgggttaaccggggttaaggggtttaaccgggggtttacccggggggtaaacgaaccggtaacggttaccggaaccgtaaccccggggg

SEQ ID NO: 440721 - DNA, 544 bp, Homo sapiens
  misc_feature: GZ8MTXP02J0UI5.10.88.H11.1.454.CMB.2.raw
  modified_base (281)..(281): a, c, t, g, unknown or other
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttggaggtggggtggggtggtcagcgcttacagttgctacacaaattngcacagaagttccaggacagagtcaccatgagcacagacacatccacgagcacagcctacataggaactgaggagccgtagagatacgtaggaacgacgaccggaccgtattactttcgtggcgacggacgacgaacggtaaaagtaggtaacggtagggtacggttaccgggggacacgtacgtacgtaaccg

SEQ ID NO: 440722 - DNA, 752 bp, Homo sapiens
  misc_feature: GZ8MTXP02G2SPR.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctcctgcgaggtcttcgtggttacacctttaacacctatggctatcgtccgtgggtcgcgacgacggcccctaggacaaggtcttggaggttggggtggggtcggtcgaggtccgtaccgtttaaccgaaaggtttcggtacctaaacgtaacgtaaaaagttttagacggacccaaaacgaacggttaaaaccggtttaccccgaagggggaacctaaagggtaacgttacccaaacccgtagtaccggaaacccaaaccgaaacgaaccaaccaactacccgaacgaacgaccaaccgacgacctacgaacgtacggaaacgtaggaacggacgaccgtaggaagacgtacgacggacgaaccgaccggtaccgttaacgttacgtttacgtacggacggtacggaacggaaacggtaaaccgggtaaaacggtacgggtaaacgggttaacggggttaacggggttaacccggggggtaacaaccggtaacgtacggtaaacccggtaacccgggg

SEQ ID NO: 440723 - DNA, 644 bp, Homo sapiens
  misc_feature: GZ8MTXP02GSHAC.10.88.H11.1.454.CMB.2.raw
  modified_base (555)..(555): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcatccttttcttggtggcagcagcaacaggtgcccactcccaggttcagctggtgcagtcgtggggctgaggtgaagagcctggggcctcagtgaagatctcctgcgaggcttctggttacacctttaacacctatggcatctccgtgggtgcgacgacggcccctggacaaggcttggaggtggggtgggtggtcgagcgcttaccgaggttcggctaacacgtaaactttgtaggacaacgtaggtaacgtttacccgagggaccgtaaggacggttccaaccctagtacgaacccgacaacgaaccacgtaactacccaacgacgaccgaactacggaccttacgaagttacggaaccgtaggagggacgaccgtaggagtacgtcgtacggaccgaaccgacggtaccgtacttagtttacgnggtacggacggtaaggacgtaaacgtaaaacggtcggtaacggtgggttacgggttacgggggactacgacgtcggaaccgtaccgggg

SEQ ID NO: 440724 - DNA, 669 bp, Homo sapiens
  misc_feature: GZ8MTXP02GT4NJ.10.88.H11.1.454.CMB.2.raw
  modified_base (375)..(375): a, c, t, g, unknown or other
  modified_base (383)..(383): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggcttcgtggttaccacctttaacacctatggctatctccgtgggtgcgacgacggcccctaggaacaaggactttggagggtggggtgggggtggtcgaggccgtactttaccgaaggtttcggactacgaanaaaatttngacaacagtaaacgttccagggacaggtacgtacaccagtcgaaaccacacgacaacactacccgaacgacgaccaacacgaccctacagtaggaaacgtaggaaggacgccgtaggaacgactacgtacggacgaaccgaccgggtaccgttaattacgtttacgtacggaccggaccggaagggtaaacggtaaacggttaaaaacggtggtaaaccgggttaagggttaaccggggttacccggggggaactaaccgtacgttacggaaccggtaacccgggg

SEQ ID NO: 440725 - DNA, 597 bp, Homo sapiens
  misc_feature: GZ8MTXP02FTBRH.10.88.H11.1.454.CMB.2.raw
  modified_base (362)..(362): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactctcaggttcagctggtgcagtctggggctggaggtgaagagccctggggcctcagtgaagatctcctgcgaggcttctggttacacctttaacacctatggcatctccgtgggtgcgacacggcccctggaacaaggacttggaggtggggtggggtggtcagcgcttaccgaagttggactacaactaaattngacacagaacgttccgaaggacaagacgtcaaccatacgaccacaagacaacactaccaacgacgacaacacgacctaacagtaggaaactaggaacggacgaccgtagaacgactacgtagaacgacgaccggaccgttacttaactttcgtacgacgacggaagaacgtaaacgtaaagtacggtaacggttacggtaacggttaccgggggactacgacgtacggaaacccg

SEQ ID NO: 440726 - DNA, 627 bp, Homo sapiens
  misc_feature: GZ8MTXP02JKTRI.10.88.H11.1.454.CMB.2.raw
  modified_base (284)..(284): a, c, t, g, unknown or other
  modified_base (361)..(361): a, c, t, g, unknown or other
  modified_base (409)..(409): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggcttctggttacacctttaacacctatggcatctccgtgggtncgacacggcccctggacaaggcttggaggtggggtggggtggtcaggccgacttaccgaaggttgctacacaaattntgacagagtaagttccaggacagacgtcacatcgaccacagacacacnccagacgcacacgacctacagtacggaactaggacggacgcccgtaggaacgtacgttacgtacggaaccggaacgaccggggtaccttaagttacgtttaccgtcggaccggtaaccggaaaggtaacggtaaaaccggttaaaaggtcggtaacggttaacgggttaacgggttacccgggggaacaaccggtagttaccggaccgtaacccgggg

SEQ ID NO: 440727 - DNA, 659 bp, Homo sapiens
  misc_feature: GZ8MTXP02G78FK.10.88.H11.1.454.CMB.2.raw
  modified_base (220)..(220): a, c, t, g, unknown or other
tcagcatagtagtgcacgaccggtgctcgatttagcgacagcgagaacacacaaaggggacccaaaaccacaccctccttgggagaatccctagatcacagctcctcaccatggactggacctggagcattccttttcttggtggcagcagcaacaggtgcccactcccaggttcagctggtgcagtctggggctggaggtgaagagcccgtggggcctnagtgaagatctctgcgaggcttctggttacacctttaacacctatggcatctccgtgggtcgcgacgacggcccctggacaaggcttggaggtggggtgggttgggtcaggcgtacttaaccgaaggttcggctaacgaactaaaattatgacaacaagtaacgttccagggacagacgtccaaccagtacgaacccaacgaacgaacacactaccgaacgacgaccaacacgacctaacacgtaggaaccgtaggaacggacgaccgtaggaacgacgttacgacggaaccgaaccggaccggtaccgttaacgttaactttcgtcggtacggacggaaacggaaacggtaaacggtaaaaacgtacgggtaacggtaaggggttaaacgggttacccggggggaactaacggaacggtacggaaccgtaacccgggg

SEQ ID NO: 440728 - DNA, 634 bp, Homo sapiens
  misc_feature: GZ8MTXP02HIEH4.10.88.H11.1.454.CMB.2.raw
  modified_base (373)..(373): a, c, t, g, unknown or other
  modified_base (427)..(427): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttctggttacacctttaacacctatgcatctccgtgggtcgcgacacggcccctggacaaggtcttggaggtggggtggggtgggtcaggccgtacttaaccgaaggttcggactaacaactaaaattncgacaacgagtaacgttccagggacagacgtcaccatacgaccacagacacacncacgagacacacgacctacagtaggaactaggaggacgccgtaggacgacgtacgtacggaaccgaccgacggtaccgttaattacgtttacgtcggacggaccggaaggaacggtaaaacggttaaaacggtacggtaacgggttaacggggttaacgggttacccggggggaactaacggtacgtacggaaccggtaacccgggg

SEQ ID NO: 440729 - DNA, 623 bp, Homo sapiens
  misc_feature: GZ8MTXP02HWNYF.10.88.H11.1.454.CMB.2.raw
  modified_base (210)..(210): a, c, t, g, unknown or other
  modified_base (266)..(266): a, c, t, g, unknown or other
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagngcccgtggggcctgagtgaagatctctgcgaggtcttcgtggttacacctttaacnctatgcatctcgtggtncgacgacggccctaggacaaggacttggaggtggggtgggtggtcgagcgtacttaccgaaggttcggactaacgaactaaaatttgcgacaacgtaaggtaacgttccgaggggactagacgttaccaacctagtacgaaccaacacgaacacaactaccaacgagccaacacgacctacagtacggaactggaacggacgacctaggacgagtacgacggaacgacgaccggtacgttaattactttcgacgtccgacgtaggaaagtaaacgtaaaggtacggtaggtaacgggttacggttaccgggggactaacgacgtacggtaccgaccgggg

SEQ ID NO: 440730 - DNA, 514 bp, Homo sapiens
  misc_feature: GZ8MTXP02GZ18Z.10.88.H11.1.454.CMB.2.raw
  modified_base (353)..(353): a, c, t, g, unknown or other
  modified_base (388)..(388): a, c, t, g, unknown or other
  modified_base (427)..(427): a, c, t, g, unknown or other
  modified_base (461)..(461): a, c, t, g, unknown or other
  modified_base (481)..(481): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtggggtggggtggtcagcgcttaccgaagttggctacacaaattangcacagaagttccaggacagagtcaccatgaccanagacacatccacgagcacagcctacataggaactgaggngcctgagatctagacgacacggccgtatatttcngcgcgagacgacgtaaaagngacgtggtacgtcggggacacgatcgactacgg

SEQ ID NO: 440731 - DNA, 596 bp, Homo sapiens
  misc_feature: GZ8MTXP02I1R9T.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttacagttggctacacaaattatgcacagaacgttcagggtacagagtacaccatcgaccacagacacatccacgagcacacgacctacataggaactaggaacgggagcccgtaggagacgtacgtagaccgaacgaccgggtacccgtattaacttttccgtagtaccggtacggaaacggaaggtaaccggtaaaaaggttggaacgggttaagggttaacggtttaccggggggaaccacgaacgttacggaaccgtaacccgggg

SEQ ID NO: 440732 - DNA, 665 bp, Homo sapiens
  misc_feature: GZ8MTXP02JZ22W.10.88.H11.1.454.CMB.2.raw
  modified_base (392)..(392): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcgagtgaagatctccgtgcgaggtcttcgtggttacctacctttaacacctatggctatctccgtgggtcgaccgacgaccggcccctaggaacaaggtcgttggagggtggggtggggtggtcaggcgtacgttaccgaaggttcggactaacgaactaaagtttagngaccaacgtaaggtaaacgttccgaggggaccaagggtactaccaacctagtacgaacccaacaacgaacacaactaccgaacgacgaccaacacgacctaacgagtacggaacgtaggaggacgtcgaggagtacgtcgtaacggacgaacgaccggtaccgtaattacgtttcgcggacggacggaaaggaacggtaaacgtaaaaggtcggtaacgggttaagggttaacgggtaccgggggacacgtacggtacggaccgtacccgggg

SEQ ID NO: 440733 - DNA, 635 bp, Homo sapiens
  misc_feature: GZ8MTXP02JR1HE.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctccgtgggtgcgacgacggcccctggacaaggtcttggaggtggggtggggtggtcaggcgtcttacgaggttgctacactaaattagcgacacgaagtaacgttccgaggtaccaggtacgtccaaccatcgaaacccaacacgacacactaccaacgacgaccacaacgacctacagtaggaacgtaggacggacgaccgtggaacgacgtacgtacggacgaccgacgggtaccgtaagttacgtttacgtcggacggaccggaaggaacggtaaaccgttaaaacggtacggtaacggtaaggggttacgggttacccggggggtaactacggtacgtacggtaaccgtaacccgggg

SEQ ID NO: 440734 - DNA, 580 bp, Homo sapiens
  misc_feature: GZ8MTXP02HE0J3.10.88.H11.1.454.CMB.2.raw
  modified_base (357)..(357): a, c, t, g, unknown or other
  modified_base (387)..(387): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtcgcgacacggcccctaggacaaggcttggaggtggggtgggtggtcaggcgcttaccgagttgctacactaaattngacacagaagttcaggacagacgtcaccancgaccacagacacactaccacgacgcacacgaccctacagtacggaaacgtaggacgggtacgccgtaggacgactcgtacgaacgacgaccggtaccgtagttacgtttcgtgcggacgaaggaacgtaacggtaaaagtcgtacggtaagggtacggttaccgggggacacgtacgtacgaacgtaccggg

SEQ ID NO: 440735 - DNA, 588 bp, Homo sapiens
  misc_feature: GZ8MTXP02F0YAO.10.88.H11.1.454.CMB.2.raw
  modified_base (278)..(278): a, c, t, g, unknown or other
  modified_base (345)..(345): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacactttaacactatggcatctctgggtncgacaggcccctaggacaaggcttgagtggggtgggtggtcagcgcttacagttgctacacaattangcacagaagttccaggaccagagtccaccatcgaccacagacacactccacgacgcaacacgacctacataggaaactagaacggacggcctaggagaactcgtacggaccgaacgaccggaccgttattaactttcgtcgacggacggaaggaaacggtaaacggtaaaaacggtcgaaaccggttaaggggtaacggtttacccggggggaaacaccggtaatacggaccgtaacccgggg

SEQ ID NO: 440736 - DNA, 544 bp, Homo sapiens
  misc_feature: GZ8MTXP02JHVPR.10.88.H11.1.454.CMB.2.raw
  modified_base (318)..(318): a, c, t, g, unknown or other
  modified_base (348)..(348): a, c, t, g, unknown or other
  modified_base (392)..(392): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtgggtgggnggtcagcgcttacagttgctacacaaattntgacacagaagttcagggacagagtcacatcgacacagacacanacacgagcaacagacctacataggaacgtgaacggagcctagaagacgtactagacgacgacggaccgtataacgtttctcggcgacgaagagaacgtaaaagtaggaacgtggtaacggtaccgggggacacgactacggaacgtaaccgg

SEQ ID NO: 440737 - DNA, 611 bp, Homo sapiens
  misc_feature: GZ8MTXP02JKZZR.10.88.H11.1.454.CMB.2.raw
  modified_base (281)..(281): a, c, t, g, unknown or other
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaggcttgaggtggggtgggtggtcagcgcttacgagttgctacgactaaattngcacagaacgttccaggacagagtcacatcgaccacacgacacactccacgagacacacgcctacagtacggaactaggacggtacgaccgtaggaacgtagtacgtacggaacgaccgaccgggtaccgttaacgttacgtttacgtcggtacggaccggtaaggtaacggtaaaccggttaaaaacggtacggtaacggtaacggggttaacggttacccggggggactaacggtacggtacggaaccgtaacccgggg

SEQ ID NO: 440738 - DNA, 532 bp, Homo sapiens
  misc_feature: GZ8MTXP02HZU3P.10.88.H11.1.454.CMB.2.raw
  modified_base (348)..(348): a, c, t, g, unknown or other
  modified_base (355)..(355): a, c, t, g, unknown or other
  modified_base (491)..(491): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttactacctttaacacctatggcatctccgtgggtgcgacacggcccctggacaaggacttggaggtggggtggggtggtcagcgcttacagttgactanacaattngcacagagttccagggtacagacgtcacatcgaacccacagacacactaccacgacgcacacgcctacataggaactgaggagctagagatcagacgacgacggcgtatacttctgcgacgagacgacgtaaaagngacggtggtacggttacgggggacacgagtcgacgtaccgg

SEQ ID NO: 440739 - DNA, 639 bp, Homo sapiens
  misc_feature: GZ8MTXP02G1MUO.10.88.H11.1.454.CMB.2.raw
  modified_base (286)..(286): a, c, t, g, unknown or other
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttcgtggttacacctttaacactatggcatctccgtgggtcncgacgacggcccctaggaacgtaaggtcgttggaggttggggtggggtcggtcaggccgtacttaaccgaaggttcggactaacaactaaagttntcgacaacgagtaacgttccagggacaggacgtccaaccgagtacgaacccaacgagaacctaacaactaccgaacgacgaccaacgacgacccgtacaacgtacggaacgtacggaaggacgacgtagaagactcgtacgaaccgacgaccggtacgtacgttacgtttcgacggcggacgaaggaacgtaaacggtaaaggtagtacgggtaaggtacgggttaccgggggacaccgagtacggacgtaaccgggg

SEQ ID NO: 440740 - DNA, 625 bp, Homo sapiens
  misc_feature: GZ8MTXP02FQIMQ.10.88.H11.1.454.CMB.2.raw
tcagcatagtagtgcacgaccggtgctcgatttagcgacagcgagaacacacaaaggggacccaaaaaccacacccctccttgggagaatcccctatatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggcttcgtggttactaccttaacacctatggctatctccgtgggtcgcgacacggcccctaggacaaggcttggaggtggggtggggtggtcaggcgtcttaccgagttggactaacactaaattatgacaacgtagaacgttaccgagggacaggtacgtaccaaccgataccgaacccaacaacgaaccaacacgtacccaacgacgaccaacacgaccctacacgtaggaaacgtaggacggacgccgtaggagactcgacgaacgacgacggtaccgttagttaacgtttcacggcgacggaaggaaacgtaaacggtaaaacggtggaacggttaagggtacgggttaccgggggaacacgacgtacgaacgtaccggg

SEQ ID NO: 440741 - DNA, 667 bp, Homo sapiens
  misc_feature: GZ8MTXP02HXZ45.10.88.H11.1.454.CMB.2.raw
  modified_base (286)..(286): a, c, t, g, unknown or other
  modified_base (355)..(355): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctggaggtgaagagcccgtgggggcctcgagtgaagatctcctgcgaggcttctggttacacctttaacacctatggcatctcctgggtncgacacggcccctggacaaggcttggaggtggggtggggtggtcaggcgcttaccgaagttggactaanaactaaattatcgacaacaggtaacgttccagggacagacgtccaaccatcgaacccacagacacactaccaacgacgaccaacacgaccctaacaagtaggaaacgtaggaacgggaagaccgtaggaacggtatacgtacggaaccggaaccgaaccgggtaccgtaacttaacgttttccgtacggtaccggtaaccggaaggaaaacggtaaaaccgggttaaaaacggtacggtaaacgggttaacggggttaacgggttacccggggggtaaccaacggtaacgtaacggtaaccggtaacccggg

SEQ ID NO: 440742 - DNA, 644 bp, Homo sapiens
  misc_feature: GZ8MTXP02H5T28.10.88.H11.1.454.CMB.2.raw
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggctttctggttacacctttaacacctatggcatctcctgggtgcgacacggcccctggacaaggacttggaggtggggtggggtggtcagcgtcttacgaagttggactacgactaaattatgacacagaacgttcaggacagagtccacatgaccacagacacactaccacgacgacaacacgaccctacacgtacggaacgtaggaacgggtacgcccgtaggaacgtacgtacgtacggaaccggaaccgaaccgggtaccgttaacgtttaacgtttccgtaggaccggaccggaaaggaaacggtaaaaccggtaaaaaggttacggtaaccgggttaacggggttaaccgggttacccggggggaaacgaacgtaacggtacggaaccgtacccggggg

SEQ ID NO: 440743 - DNA, 575 bp, Homo sapiens
  misc_feature: GZ8MTXP02JLO91.10.88.H11.1.454.CMB.2.raw
  modified_base (353)..(353): a, c, t, g, unknown or other
  modified_base (358)..(358): a, c, t, g, unknown or other
  modified_base (362)..(362): a, c, t, g, unknown or other
  modified_base (412)..(412): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcgagtgaagatctcctgcgaggcttctggttacacctttaacacctatggcatctccgtgggtcgcgacacggcccctggaaccaaggcttggaggtggggtggggtggtcaggcgcttacgagttgctacanaattngcanagaagttccagggacagacgtcaccatcgaccacagacacataccacgancacacgcctacataggaactggaggacgcgtagagacgtcgtacgacgacgacggaccgtagtactttacgtcggacgacggaaggaacggtaacgtaaaaggtacggtaacggtaacgggttacggttaccgggggtacaccgtagtacggaacgaaccggg

SEQ ID NO: 440744 - DNA, 592 bp, Homo sapiens
  misc_feature: GZ8MTXP02JMO1S.10.88.H11.1.454.CMB.2.raw
  modified_base (206)..(206): a, c, t, g, unknown or other
  modified_base (281)..(281): a, c, t, g, unknown or other
  modified_base (349)..(349): a, c, t, g, unknown or other
  modified_base (358)..(358): a, c, t, g, unknown or other
  modified_base (386)..(386): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccatcccaggttcagctggtgcagtctgggctgaggtgaagngccctggggcctgagtgaagatctcctgcgaggctttctggttacacctttaacacctatggcatctcctgggtncgaccaggcccctggacaaggcttggaggtggggtggggtgggtcagcgcttaccgaagttggactanacaaagttngctacagtagtcagacagacgtacacanacgaaccaacacgaccacacaccgacgacgaccacgacgtacctacgacgtacggaacgaggaggacgtcgtagagtacgtaccgtacgaaccgtaccgtaccggtaccgttaacttacgtttcggacgcgacggaaggaacggtaaacgtaacgtacggtacggtaagggtacggtaccggggacacgtacgtacgaccgaccgg

SEQ ID NO: 440745 - DNA, 545 bp, Homo sapiens
  misc_feature: GZ8MTXP02FV5SE.10.88.H11.1.454.CMB.2.raw
  modified_base (353)..(353): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggaccaaggcttgaggtggggtggggtggtcagcgcttacgaagttgctacacaaattntgacacagaagttccaggacagagtcacatcgaccacagacacataccacgagcacacgcctaacataggaactaggaggacgccgtagagactcgtagaccgacgaccggacgtattatttctgcgacgagaacgaacgtaaaaggtgaacggtggtacggttaccgggggacacgagtacgacgaccggg

SEQ ID NO: 440746 - DNA, 631 bp, Homo sapiens
  misc_feature: GZ8MTXP02H0KVR.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttcgtggttaaccacctttaacacctatggcattctccgtgggtcgccgacgacggccccctagggacaaggtacgttggaggtggggtggggtgggtcaggcgtcttaaccgaaggttggacctaacgaactaaagttatgacaacgaggtaaacgttccgagggtacaaggacgtaccaaccgatcgaacccacgacgactacactcccaagacgcacacgacctacgataggaacgtaggaaggacgaccgtagagaacttcgacgaccgaacgaccggtacgttaattacgtttcgagaccggacgaaggaagtaaacggtaaaaggttgacggtaacgggttacggttaccgggggactacgacgtacggaaccacccgggg

SEQ ID NO: 440747 - DNA, 547 bp, Homo sapiens
  misc_feature: GZ8MTXP02IYI9H.10.88.H11.1.454.CMB.2.raw
  modified_base (341)..(341): a, c, t, g, unknown or other
  modified_base (349)..(349): a, c, t, g, unknown or other
  modified_base (470)..(470): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctctgggtgcgacaggcccctggacaaggcttgagtggggtggggtggtcagcgcttacaagttgctanacaaattntgcacagaagttccaggacagagtccaccatgaccacagacacataccacgagccacacgacctacataggaactaggaggagcctagagatctgacgacgacggtaccgtatatttacgngtcgacgagaacgacgtaaaaacgtgtaacggtaaggtaacggttaccgggggaacgtacgagtacgactaaccggg

SEQ ID NO: 440748 - DNA, 576 bp, Homo sapiens
  misc_feature: GZ8MTXP02JAKJU.10.88.H11.1.454.CMB.2.raw
  modified_base (360)..(360): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatcgtcctgcgaggtcttctggttacacctttaacacctatggcatctccgtgggtgcgacacggcccctggacaaggcttggaggtggggtggggtggtcaggcgtcttacgagttgactacactaaattngacacgagaacgttccagggacaggagtaccaccagtcgaaccaacagacacactaccacgagccacacgcctacagtaggaacgtagaggacgaccgtaggagactcgtacggaacgaccgacggtaccgtattacgttcgtgacgacgaagaacggtaacgtaaaagtaggacggtggtacggtaccgggggacacgacgtacgacgtaccggg

SEQ ID NO: 440749 - DNA, 594 bp, Homo sapiens
  misc_feature: GZ8MTXP02GSOXH.10.88.H11.1.454.CMB.2.raw
  modified_base (278)..(278): a, c, t, g, unknown or other
  modified_base (352)..(352): a, c, t, g, unknown or other
tcagcatagtagtgcacgaccggtgctcgatttagcgacagcgagaacacacaaagggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacactttaacacctatggcatctcctgggtncgacacggcccctggacaaggcttggagtggggtgggtgggtcaggcgcttacgaagttggctacacaaattangacacagaattccagacagagtcaccatcgaccacagacacatccacgagacacgacgactacactaggaaactaggaaggacgaccctaggaagactacgtacgaaccgaacgaccgggaccgttattaacgtttccgtacgtaccggacgaacggaaacggtaaaccggttaaaaaggtcggtaacggtaagggtacggtttaccggggggaacacgtaacgtacgaccgtaacccgggg

SEQ ID NO: 440750 - DNA, 673 bp, Homo sapiens
  misc_feature: GZ8MTXP02H1E7B.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggtcttcgtggttacacctttaacacctatggcatctccgtgggtgcgacgacggcccctaggacaaggtacgtttggaggtgggggtggggtgggtcaggcgtcgttaccgaaggttcggactaacgaactaaaatttagtacgacaacgtaaggtaacgttacccgaggggtaaccaaggaacgtaccaaccgtagtacgaaacccacgaacgaaccaacactacccgaacgacgaccaacacgacctacagtaggaacgtaggaacggacgaccgtaggagacgtcgtacgaacgacgaaccggtaccgttaaattacgtttacgcggtacggacggaaaggaacggtaaaccggttaaaaggtacggtaacggttaacgggtacggttaccgggggaactaacgtacggttacggaacgtacccgggg

SEQ ID NO: 440751 - DNA, 514 bp, Homo sapiens
  misc_feature: GZ8MTXP02IN61R.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttaccaagttggctacacaaattatgcacagaagttccagggacagagttcaccatgaccacagacacatccacgagcacagcctacataggactgaggagcctgagatctagacgacacggccgtatattctgcgcgagagacgtaaaagtgacgtggtagttacgggggacacgatcgactaccgg

SEQ ID NO: 440752 - DNA, 597 bp, Homo sapiens
  misc_feature: GZ8MTXP02HMTEO.10.88.H11.1.454.CMB.2.raw
  modified_base (208)..(208): a, c, t, g, unknown or other
  modified_base (221)..(221): a, c, t, g, unknown or other
  modified_base (282)..(282): a, c, t, g, unknown or other
  modified_base (397)..(397): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagngccctggggcctnagtgaagatctctgcgaggcttctggttacacctttaacacctatggcatctccgtgggtncgacacggcccctggacaaggcttgaggtggggtggggtggtcagcgtcttacaagttggactacgaacaaatttatgacaacagtaacgttccagggacagacgtccaacctanacgaacccacagacacactaccacgacgacaacacgacctacagtagaacgtagaggagcctagagatacgtagacgacgacggtaccgtagttactttcgaggtcgacgaacggaagtaaaccggtaaaagtaggtaaccggtaagggttaacgggttaccgggggaacaacggtacgtacggtaaccgtaacccgggg

SEQ ID NO: 440753 - DNA, 546 bp, Homo sapiens
  misc_feature: GZ8MTXP02FHM3Z.10.88.H11.1.454.CMB.2.raw
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtgggtggggtggtcagcgctacaagttgctacacaaattatgcacagaagttcaggacagagtcacatgagcacagacacataccacgacgacaacacgacctacagtaggaacgtagaggacgccgtagagatactagacgacgaccggtaccgtaattactttacgtgcgacgagaacgaacggtaaaagtaggaacggtaggtacggttaccgggggaacacgacgtacgaaccg

SEQ ID NO: 440754 - DNA, 619 bp, Homo sapiens
  misc_feature: GZ8MTXP02HA2HZ.10.88.H11.1.454.CMB.2.raw
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttctggttacacctttaacacctatggcatctccgtgggtcgcgacgacggcccctggaacaaggtacttggaggtggggtggggtggtcaggcgtcttaaccgaaggttcggactaacactaaagttangacaacgagtaacgttaccgagggacagacgtcaccatcgaaccacacgaacacactaccaacgagaccaacacgacctacataggaactaggaaggacgaccgtaggaagacgtacacggaacgaaccgacggtaccgttaattaacgtttcgacgacggtacggaaagaaacggtaacggtaaaagtaggtaacggtaagggtaacggttaccgggggaactacgacgtacgacgtaacccggg

SEQ ID NO: 440755 - DNA, 537 bp, Homo sapiens
  misc_feature: GZ8MTXP02F2MV7.10.88.H11.1.454.CMB.2.raw
  modified_base (359)..(359): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctctgcgaggcttctggttacacctttaacacctatggcatctcctgggtgcgacacgggcccctggacaaggcttggaggtggggtggggtggtcgagcgcttaccaaggttggctaacacaaattntgcacagaacgttccagggacagagtcaccatcgaccacagacacataccacgagacacacgacctacataggaactgaggagcctagagatcgtagacgacgacgacgtagtacttctgcgcgagagaacgtaaagtgacgtaaggtacgtaccggggacacgactacgactaccgg

SEQ ID NO: 440756 - DNA, 525 bp, Homo sapiens
  misc_feature: GZ8MTXP02JDY5B.10.88.H11.1.454.CMB.2.raw
  modified_base (281)..(281): a, c, t, g, unknown or other
  modified_base (347)..(347): a, c, t, g, unknown or other
  modified_base (351)..(351): a, c, t, g, unknown or other
  modified_base (463)..(463): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtggggtgggtggtcagcgcttaccagttgctacacaattngcanagaagttcagggacagacgtcaccatcgaccacagacacataccacgagcacacgacctacataggaactgaggagcctagagagtcgtagacgacgacggcgtatacttcngcgacgagacgacgtaaaagtgacggtggtacgtacgggggactacgacgtacgactaccgg

SEQ ID NO: 440757 - DNA, 512 bp, Homo sapiens
  misc_feature: GZ8MTXP02GBE37.10.88.H11.1.454.CMB.2.raw
  modified_base (391)..(391): a, c, t, g, unknown or other
  modified_base (397)..(397): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgagtgggtgggtggtcagcgctacgagttggctacgacaaattatgcacagaagttcaggacagagtcaccatgacacagacacancacgancacagcctacatagaactgaggagacgtgagatcgtgacgacgacggacgtatattctgcgcgagacgaacgtaaagtgacgtggtagttaccggggacacgagtcgacgtacgg

SEQ ID NO: 440758 - DNA, 678 bp, Homo sapiens
  misc_feature: GZ8MTXP02JMZFQ.10.88.H11.1.454.CMB.2.raw
  modified_base (286)..(286): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctccgtgcgaggtcttctggttacacctttaacacctatggcatctctgggtncgacgacggccctaggacaaggcttggaggtggggtggggtggtcaggcgtacttaccgaaaggtttggacctaacgtaactaaaacgtttagtcggacaacgtaggtaacgttccgagggtaacagacgtccaacagtacgaacccaacgacgaaccaacgactaccgaacgacaccaacgacgacctaacgagtacggaaccgtagggaacggtacgaccgtaggacgtacgttcgacggaaccgaaccgaccgggtaccgttaagttacgtttcgtcggaccggaacggaaacggtaacgggtaaaacgttaaaaggtacggtaacggggttaagggttaacggggtaccgggggtaacaacggtaacgtacggaacggtaacccgggg

SEQ ID NO: 440759 - DNA, 668 bp, Homo sapiens
  misc_feature: GZ8MTXP02JQKFW.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacaccttaacacctatggcatctccgtgggtgcgacgacggcccctaggacaaggcttggaggtggggtggggtggtcaggcgtcttaaccgaagttggctaacaactaaattatgacaacgagaacgttccagggacaaggacgtcaaccatacgaaccacaacgaccaacactacccacgacgaccaaccaacgaccctaacacgtacgggtaaactaggaacggacgacccgtaggaacggtactaccgtacggaaccggaacgaccgggtaaccgtaagttaacgtttaccgtacggaccggacggaaacggtaaacggtaaaaccggttaaaaaggtacggtaacgggttaaggggttaaccgggttaccggggggtaacaaccgtaaggtaccggtaaccgtaacccggggg

SEQ ID NO: 440760 - DNA, 657 bp, Homo sapiens
  misc_feature: GZ8MTXP02FN8XP.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcgtgggtgcgacgacggcccctggacaaggacttggaggtggggtggggtggtcaggcgtcttaaccgaaggtttggactaacaactaaaatttagtgacaacgaggaaacgtttccgagggaccaggacgtaccaaccagtacgaacccaacagaaccacactacccaacgacgaccaacacgaccctaacacgtagggaaacgtaggaagggacgaccgtaggaagtacgtacgtacggaaccgaaccgaccgggtaccgttaacgttacgtttacgtacggtaccggaccggaaggaaacggtaaaccggttaaaaggtacggtaacggttaaggggttacggttaccgggggaacacgacgtacggaaccgtacccgggg

SEQ ID NO: 440761 - DNA, 619 bp, Homo sapiens
  misc_feature: GZ8MTXP02JMV9L.10.88.H11.1.454.CMB.2.raw
  modified_base (366)..(366): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcgagtgaagatctcctgcgaggcttctggttacacctttaacacctatgcatctccgtgggtgcgacacggcccctggacaaggcttggaggtggggtggggtggtcaggcgtcttaccgaaggttcggactaacgactaaaattntgacaacgagtaaacgttacccgagggaccaagacgtaccaaccagtacgaccaacagacacacaccacgagcaacacgacctacagtagaacgtagacggagaccgtaggagacgtcgtacgaacggaccgaaccggtaccgttaagtacgtttcgtacgacggacggaaacggaacggaaaacgtaaaaggtacggtacggtaagggtaacggttaccgggggaacaacgacgtacggacgtaacccgggg

SEQ ID NO: 440762 - DNA, 656 bp, Homo sapiens
  misc_feature: GZ8MTXP02HNJVU.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccctggacaaggacttggagtggggtggggtggtcagcgtcttaccgaagttggctacgacaaattatgcacagaacgttccaggacagagtcaccatgaccacagacacactaccacgacgcaacacgacctaacagtaaggaaccgtagggaacgggtacgtccgtaggaacgtacgttacgtacggaaccggaccggtaacccggggtacgtttaactttaacgtttccgttacgggaccggtaccgggaaaggtaaccggtaaaacgggtttaaaacggtacgggtaccgggttaaggggttaaccgggggttaccgggggtaacctaacgtacggttacggaacccggtaacccggggg

SEQ ID NO: 440763 - DNA, 706 bp, Homo sapiens
  misc_feature: GZ8MTXP02IKJTE.10.88.H11.1.454.CMB.2.raw
  modified_base (285)..(285): a, c, t, g, unknown or other
  modified_base (376)..(376): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagcgcccgtggggcctcgagtgaagatctcctgcgaggtcttcgtggttacacctttaacacctatggcatctcgtggtncgacgcggccctggacaaggtcttggaggtggggtggggtggtcgaggcgtacttaaccgaggttcgactaacgactaaattgtacgacanagtaacgttccgagggacaggtacgtaccaacctagtacgaccaacgagaaccgaacactacccgaacgacgaccgaacacgaccctaacgtaacgtacgggtaaaccgtaggaacgggtacgacccgttaggaacgtacgtaccgtacgaaccggaaccgtaaccgggtaccgttaacgtttaacgtttcgtacggtaccggtacggaaacggtaaacggtaaaaccggttaaaaacggtacgggttaaacgggttaaggggttaaccgggggtttaacccggggggaaaacctaacggtaacggtacggtaacccggtaaacccgggg

SEQ ID NO: 440764 - DNA, 559 bp, Homo sapiens
  misc_feature: GZ8MTXP02GNB44.10.88.H11.1.454.CMB.2.raw
  modified_base (355)..(355): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggctctggttacacttaacacctatggcatctcgtgggtgcgacacggcccctggacaaggacttggaggtggggtggggtggtcagcgcttacgaagttggactacgactaaaattntgacaacgagtaaacgttccgaggacagagtccacatgaccacagacacactacacgagacaacacgacctacacgtaggaaactaggaacggagacctaggaagaacgtcgtacgaacgaacgaccggaccgtagtattcgtgacgacgagaagaacgtaaagacgagtaaggtacgtacgggggacacgactcgacgaccgg

SEQ ID NO: 440765 - DNA, 508 bp, Homo sapiens
  misc_feature: GZ8MTXP02HDN4T.10.88.H11.1.454.CMB.2.raw
  modified_base (281)..(281): a, c, t, g, unknown or other
  modified_base (337)..(337): a, c, t, g, unknown or other
  modified_base (345)..(345): a, c, t, g, unknown or other
  modified_base (349)..(349): a, c, t, g, unknown or other
  modified_base (365)..(365): a, c, t, g, unknown or other
  modified_base (370)..(370): a, c, t, g, unknown or other
  modified_base (378)..(378): a, c, t, g, unknown or other
  modified_base (391)..(391): a, c, t, g, unknown or other
  modified_base (401)..(401): a, c, t, g, unknown or other
  modified_base (454)..(454): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtggtcagcgcttacagtgctanacaattangcanagagtcgagacagacncacancgacacanacacacacacganacacacacanagagactagaggacgactagagtactcgtagacgacgacggacgtatacttcngcgacgagacgaacgtaagtgacgtggtacggtacgggacagacgacgacgacg

SEQ ID NO: 440766 - DNA, 594 bp, Homo sapiens
  misc_feature: GZ8MTXP02GX56S.10.88.H11.1.454.CMB.2.raw
  modified_base (283)..(283): a, c, t, g, unknown or other
  modified_base (363)..(363): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctccgtgggtncgacacggcccctggacaaggacttgaggtggggtggggtggtcaggcgtcttaccgaggttcggactacactaaatttntgacacagtaacgttcgagggtacagacgtaccaaccagtcgaaccacagacacacaccacgagacacacgacctacagtaggaaacgtagacggagaccgtagagatcgtaggacgacgacggtaccgtatacgtttcgtcggacgacggaacggaacgaacgtaaaagtcggtaacggttaagggtacggttaccgggggactacgtacgtacggaacgtaacccgggg

SEQ ID NO: 440767 - DNA, 706 bp, Homo sapiens
  misc_feature: GZ8MTXP02H0U1H.10.88.H11.1.454.CMB.2.raw
  modified_base (272)..(272): a, c, t, g, unknown or other
  modified_base (286)..(286): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtgggctggaggtgaagagcccgtggggcctcagtgaagatctctgcgaggcttcgtggttactacctttaacacctatggnatctccgtgggtcncgacacggcccctaggacaaggcttggaggtggggtggggtggtcaggcgtcttacgaaggttcggactaacgaactaaattatacgacaacgaaggtaaacggttacccaggggaaccaaggtaccgtaccgaaccctagtaccgaacccaaacgaacgaaccaacctacacccgaacggaacgacccaacgaacgtaccctaacgtaacgtacggggtaaaccttagggaacgggacggaccgttaagggagtaacgttaccgtaacgggaaccggaaccgtaacccggggtccttaaaacgtttacctttcgtacggccggtaacggaacggaaaggtaaaaccgtaaaaggtggtaaaccgggttaagggttaacgggttaccgggggacacgtaacggtacggaaccggaccggg

SEQ ID NO: 440768 - DNA, 660 bp, Homo sapiens
  misc_feature: GZ8MTXP02HZ4DH.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtctggggctggaggtgaagagcccgtggggcctcagtgaagatctcctgcgaggtcttctggttactacctttaacacctatgcatctccgtgggtcgcgacgacggcccctggacaaggtacgttggagggtggggtggggtggtcaggcgtcttaccgaggtttggactaacaactaaatttagcgacaacgaagtaacgttaccgagggacaagacgtaccaaccagtacgaccaacagaccacactccaacgacgaccacacgcctactacgtacggaacgtaggagggtaacgccgtaggagacgttcgacggaaccggaacgaccggtacgttacgtttaactttcgtacgggtacgacggaaggtaaacggtaaacggttaaaaggtacgggtaaacggttcgggggttaccgggttaaccggggggtaacaacggtacggttacggaaccggtacccggggg

SEQ ID NO: 440769 - DNA, 564 bp, Homo sapiens
  misc_feature: GZ8MTXP02HJR9U.10.88.H11.1.454.CMB.2.raw
  modified_base (219)..(219): a, c, t, g, unknown or other
tcagcatagtagtgcacgaccggtgctcgatttagcgacagcgagaacacacaaaggggacccaaaaaccacatccctccttgggagaatcccctagatcacagctcctcaccatggactggacctggagcatccttttcttggtggcagcagcaacaggtgcccactcccaggttcagctggtgcagtctggggctgaggtgaagagcctggggcctnagtgaagatctcctgcgaggcttctggttacactttacactatgcatctcgtggtgcgacgacggccccgtggacaaggtacgtgaggtggggtggggtgggtcgagcgcgttacaagttgctacaccaaattatgcacagagttccagacagagtcacatcgaccacagacacactcacgacgacacacgacctacataggaactggaaggacgacgtagagactacgtacgaacgacgacggtaccgtaacttacttcgtagcgacggaacgacgaaacgttaaaacggtacggtaacggtagggttaacggtaccgggggtaacaccggtagtacgaaccgg

SEQ ID NO: 440770 - DNA, 739 bp, Homo sapiens
  misc_feature: GZ8MTXP02IKI1F.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagacgcccgtggggcctcagtgaagatctcctgcgaggtcttcgtggttaccacctttaacacctatggcatcctccgtgggtcgcgacgacggcccctggacaaggtacttggaggtggggtggggtggtcaggcgtcgttaaccgaggttcggacctaacgaactaaaagtttagtcgactaacgaaggtaaacgtttccgaggggtaccaagggtaacgttacccaaacccgtagtacgaacccaaaccgaacgaaccaacactacccgaacgacgaccaacgacgaccctacaacgtacggaaacgtaggaggtacgccgtaggaacgtacgtaccgtacggaaccgaaccggtaaccgggtacccgtaacgtttaacgttttaccggtcggtaccggtaaccggtaaagggaaaccgggtaaaacgggttaaaacggtacgggtaacgggttaacgggggttaacgggtttaacccggggggtaaccgaaaccggtaacggttaccgggtaacccggtaaccccgggg

SEQ ID NO: 440771 - DNA, 649 bp, Homo sapiens
  misc_feature: GZ8MTXP02JLKDB.10.88.H11.1.454.CMB.2.raw
  modified_base (294)..(294): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgcccgtggggcctcgagtgaagatctcctgcgaggtcttcgtcggttactacctttaacacctatcggcatctccgtgggtncgacgacggccctaggaacaggcttggaggtggggtggggtggtcaggtcgtcttaacgaaggttggacctaacaactaaaattgtgacaagaagtaacgttccaggggtaacaggtacgtccaacctagtacgaaccaacaagaacacgaactaccgaacgacgaccaacgacgacctaacagtacggaaacgtaggaacggacgtaccgtaggaacgtactacgacggaccgacgtaccgggtacctagttacttcgacgtacgacggaaagaaacgtaacggttaaaaggtcggtaaacggtaacggtacggggtaccgggggaacacggtacgtacggacgtaacccgggg

SEQ ID NO: 440772 - DNA, 609 bp, Homo sapiens
  misc_feature: GZ8MTXP02IOOXJ.10.88.H11.1.454.CMB.2.raw
  modified_base (286)..(286): a, c, t, g, unknown or other
  modified_base (357)..(357): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatcctttttcttggtggcagcagcaacaggtgcccactcccaggttcagctggtgcagtctggggctgaggtgaagagcccgtggggcctcgagtgaagatctcctgcgaggtcttctggttacctacctttaacacctatgcatctccgtgggtncgacacggcccctggacaaggcttggaggtggggtggggtggtcagcgtctacgagttgctacactaattngacacagaacgttccaggacagacgtcacatcgaccacagacacacaccaacgagaccacgacgacctacagtacggaacgtaggaaggacgccgtagaacgtagtacgtacgacgaacgaccggtaccgtattactttacgtcggtacggacggtaacggaacggtaaacggtaaaaaggtacggtaacggttaacggggttaacgggttaccgggggtaactaacgtacgttacgaacggtaacccgggg

SEQ ID NO: 440773 - DNA, 565 bp, Homo sapiens
  misc_feature: GZ8MTXP02HUWW3.10.88.H11.1.454.CMB.2.raw
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctggaggtgaagagcccgtggggcctcgagtgaagatctcctgcgaggcttctggttacacctttaacacctatggcatctccgtgggtgcgacacggcccctggacaaggacttggaggtggggtggggtggtcagcgtacttacgagttgactacgactaaattatagacacgagaacgttcgaggacagagtcacancgaccacagacacactaccacgacgacacacgacctacagtaggaactaggaggacgacgtagagactacgtacgacgacgacggacgtatactttcgtagcgacgagaacgtaacgtaaagtgacggtaaggtacggttaccgggggacacgacgtacgtacgaccgg

SEQ ID NO: 440774 - DNA, 633 bp, Homo sapiens
  misc_feature: GZ8MTXP02F930O.10.88.H11.1.454.CMB.2.raw
  modified_base (285)..(285): a, c, t, g, unknown or other
  modified_base (361)..(361): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttctggttacacctttaacacctatggcatctccgtgggtcncgacacggcccctggacaaggcttggaggtggggtggggtggtcaggcgcttacgaagttggactacactaaattntgacaacgagtaacgttcgagggacaggacgtccaaccatcgaacccacgaagaaccacaactacccgaacgacgaccaacacgacctaacgacgtaggaaactaggaacggtacgaccgtaggaacgacgtacgtacggacgaaccgacggtaccgtaagttactttacgtcggacgacggaaggaacggtaaaccgtaaaaacggtcggtaaacggttgggtaacgggttaccgggggaacacggtaacgtacggaaccgtaacccgggg

SEQ ID NO: 440775 - DNA, 613 bp, Homo sapiens
  misc_feature: GZ8MTXP02GT6QL.10.88.H11.1.454.CMB.2.raw
  modified_base (301)..(301): a, c, t, g, unknown or other
  modified_base (388)..(388): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcattccttttcttggtggcagcagcaacaggtcgcccactcccaggttcagctggtgcagtcgtgggctggaggtgaagagcccgtggggcctgagtgaagatctccgtgcgaggtcttcgtaggttaacctaccttttaaacacctagtcggactatcctccgtggggtcncgaacgacggcccctggaacaaggtacgttggaggtggggtggggtggtcagcgtacttaaccgagttggctaacaactaaatttangacacagaacgttcgagggacaaggacgtccaacctatcgaacccacaacgacaacaactaccaacgaacgcaacgacgacctaacagtaggaactaggaggacgccgtaggagtactcgagaaccgacgacggaccgttatacgttcgacgtcgacggaagaacgaacgtaaaagtggaacgtggtacggtaccgggggacacgtacgtacggactaaccgggg

SEQ ID NO: 440776 - DNA, 614 bp, Homo sapiens
  misc_feature: GZ8MTXP02H53W9.10.88.H11.1.454.CMB.2.raw
  modified_base (353)..(353): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttttcttggtggcagcagcaacaggtgcccactcccaggttcagctggtgcagtctggggctgaggtgaagagcccgtggggcctcgagtgaagatctcctgcgaggtcttctggttaccaccttttaacacctatggcatctcctgggtgcgacacggcccctggacaggcttggagtggggtggtggcagcgcttacagttgctacactaattangcacagaagttccagggacagagtcaccagtcgaccacagacacactaccacgacgaccgacacgaccctacagtaggtaaacgtaggaaggacgaccgtagaacgtactacgtacgaccggaacgaccgggacccgttaattacgtttacgtcggccggacggaacggaaacggtaaccggttaaaaaggtacggtaacgggttaacgggttaacggttaccggggggactaacggtacgttacggaacgtaacccgggg

SEQ ID NO: 440777 - DNA, 664 bp, Homo sapiens
  misc_feature: GZ8MTXP02I8ILR.10.88.H11.1.454.CMB.2.raw
  modified_base (381)..(381): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctcctgcgaggtcttctggttaccacctttaacacctatggcatcctccgtgggtcgcgacacggcccctaggaacaaggcttggaggtggggttgggttggtcaggcgtcttaaccgaaggtttcggacctaacgaactaaaatttngacaacgagtaacgttcccaggggacaggtacgtaccaaccagtacgaacccaacaacgaaccaacaactacccaacgacgaccaacgacgacctacgaacgtacggaaacgtaggaaggacgccgtaggaagtacgtacgtacgaccgaacgaccggtaccgttagttaacgtttacgtcggcggacggtaaaggaaacggtaaacggtaaaaggtacggtaacggttaacgggtacgggttaccgggggaactacggtacgtacggaacggtaacccgggg

SEQ ID NO: 440778 - DNA, 688 bp, Homo sapiens
  misc_feature: GZ8MTXP02FZDWE.10.88.H11.1.454.CMB.2.raw
  modified_base (208)..(208): a, c, t, g, unknown or other
  modified_base (291)..(291): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagngccgtggggcctcagtgaagatctcctgcgaggtcttctggttacctaccttaacacctatggcatctccgtgggtcgcgacncggcccctggacaaggcttggaggtggggtggggtggtcgaggccgacttaaccgaaggtttcggactaacaactaaattangacaacgaaggtaaacgttccgagggtacaggtacgtaccaaccaatcgaaacccaacaacgaccaacactacccgaacgacgaccaacacgtaccctaacgacgtacgggaaacgtagggaacgggacgtacccgtaggaacgtaacgttcgtacggaaccgaaccgaccggtacccgttatttaacgtttcgtacggacggaccggaaaggtaaacggtaaaaccggttaaaagtcgggtaaacgggttaacggggttaacggggttaaccggggggaacaacgtaacggttaccggaaccgtaacccggggg

SEQ ID NO: 440779 - DNA, 516 bp, Homo sapiens
  misc_feature: GZ8MTXP02JFJGQ.10.88.H11.1.454.CMB.2.raw
  modified_base (345)..(345): a, c, t, g, unknown or other
  modified_base (388)..(388): a, c, t, g, unknown or other
  modified_base (394)..(394): a, c, t, g, unknown or other
  modified_base (400)..(400): a, c, t, g, unknown or other
  modified_base (406)..(406): a, c, t, g, unknown or other
tcagcatagtagtgcacgaccggtgctcgatttagcgacagcgagaacacacaaagggacccaaaaccacaccctccttgggagaatccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtggtgggtggtcagcgcttaccaagttgctacacaaaattntgcacagaaattccaggacagagtcaccatgacacagacacancacganacacanacacanagaagtagagagcagagatactagacgacgacgacgtatattctgcgacgagagaacgtaaaacgtaagacgtaaggtacggtacggggtacgacgacgtacgacgaccg

SEQ ID NO: 440780 - DNA, 655 bp, Homo sapiens
  misc_feature: GZ8MTXP02H23MM.10.88.H11.1.454.CMB.2.raw
  modified_base (281)..(281): a, c, t, g, unknown or other
  modified_base (358)..(358): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatgcatctccgtggtncgacacggcccctggacaaggcttggaggtggggtggggtggtcagcgtcttaccgaggttcgctaacactaaattntacgcaacagtaacgttccgaggtacaagacgtacaaccagtcgaacccacacgaaccacactacccaacgacgaccaacacgaccctacaagtacgggaaacctagggaaggacgtacccgtaggaacgtaacttcgacggaaccggaacgaccgggtacgtaacttaacgtttcgtaggaccgacggtaaaggaacggtaaaacggttaaaacggtcgggtaaccggttaaggggttaaccggggttaacccggggggtaacaacgtaacggtacggtaacccggtacccggggg

SEQ ID NO: 440781 - DNA, 619 bp, Homo sapiens
  misc_feature: GZ8MTXP02F6YJS.10.88.H11.1.454.CMB.2.raw
  modified_base (363)..(363): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtctggggctgaggtgaagagccctggggcctcagtgaagatctcctgcgaggcttctggttacacctttaacacctatggcatctctgggtgcgacacggcccctggacaaggacttggaggtggggtggggtggtcaggcgtcttaccgaaggttcggactacaactaaatttangacacgaaggaacgtttaccagggaccaaggacgtaccacctatcgaacccaacacgaacacaactacccaacgacgaccaacacgacctaacacgtaggaacgtaggacggacgccgtagagactcgtacgacgacgaccggtaccgtagttactttcgtcgtcggacggtaacggaacgtaaacggtaaaaggtcggtaacggtaacgggttacggttaccggggggactacggagttacggacgtaaccgggg

SEQ ID NO: 440782 - DNA, 671 bp, Homo sapiens
  misc_feature: GZ8MTXP02IIOV5.10.88.H11.1.454.CMB.2.raw
  modified_base (223)..(223): a, c, t, g, unknown or other
  modified_base (408)..(408): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagcgcccgtgggcctnagtgaagatctctgcgagtctttcgtgttaacctacctttaacacctagtggcatctccgtgggtcacgacacggtcccctggaacaaggtacttggaggtggggtgggtggtcagcgtacttacgaaggtgactacaactaaatatgacacagaacgttcaggacagatccacatacgaccaanagaacacactaccgacgacgacaacacgacctaacgagtaacggtaaccgtaggaacgggtacgcccgttaagggaacgtacgttaccgaacggaaccggaacccgaacgggtacccgtaagtttaacgtttcggtacggaccggtaacgtaaacgggaaaacggttaaaccgggttaaaacggttacggtacgggttaacggggttaaccgggttacccggggggaactaacggtaacgtaccggtaaccgtaacccggggg

SEQ ID NO: 440783 - DNA, 604 bp, Homo sapiens
  misc_feature: GZ8MTXP02JN8O7.10.88.H11.1.454.CMB.2.raw
  modified_base (208)..(208): a, c, t, g, unknown or other
  modified_base (241)..(241): a, c, t, g, unknown or other
  modified_base (365)..(365): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagngcccgtggggcctcgagtgaagatctcctgcgnggcttctggttacacctttaacacctatggcatctccgtgggtgccgacacggcccctggacaaggcttggaggtggggtggggtggtcaggtcgtcttaccgagttggactacgactaaattngacacagaacgttccagggacaggacgtaccaccgatacgaacccacaacgacacactaccgaacgacgacaacacgacctacgagtaggaactaggacgggacgccgtagaagagtacgacgaacgacgaccggtaccgttagttagtttggtacggcggacggaaggaacggtaaacggtaaaacggtggtaacgggtggtacggttaccgggggacacgtagtacgacgtaccggg

SEQ ID NO: 440784 - DNA, 616 bp, Homo sapiens
  misc_feature: GZ8MTXP02F4OBE.10.88.H11.1.454.CMB.2.raw
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtcncgacacggcccctaggacaaggcttggaggtggggtggggtggtcaggcgcttaccgaaggtttcggactaacgaactaaattatcgacaacgagtaaacggttcccgaggggacaggagtaccaccatcgaaccaacagaccacactaccacgacgcacacgacctacagtacggaacgtgaacgggacgaccgtagagacttcgacggaacgaacgtaaccgggaccgttaagttacgtttcgtacggacggacggtaagaacggtaacgtaaaagtcggtaacggtgggtaacggttacgggggaccacgtacgtacggacgtaaccggg

SEQ ID NO: 440785 - DNA, 642 bp, Homo sapiens
  misc_feature: GZ8MTXP02I9AD2.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagagcccgtggggcctcagtgaagatctccgtgcgaggtcttcgtggttacctacctttaacacctagtggcatctccgtgggtgccgacgacggcccctaggacaaggtcttggaggtggggtggggtggtcaggcgtcttaaccgaaggttcggactaacaactaaaattatgacaacgaagtaaacgttcccgaggggaccaaggacgtacccgaacctaagtacgaaacccaaacgaacgaaccaacgaactacccgaacgacgaccaacgacgacccgtaacagttacgggaaactggaaggacgccgtagaagatcgagacgacgacggtacctattacttcgtagcggacggagaacggtaaacgtaaaagtcggacggtaagggttacggtaccgggggtaacacggacgtacggaccgtaaccggg

SEQ ID NO: 440786 - DNA, 594 bp, Homo sapiens
  misc_feature: GZ8MTXP02JTKKQ.10.88.H11.1.454.CMB.2.raw
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttggaggtggggtggggtggtcagcgcttaccgagttggactacgacaaattntgacacgagaagttccaggacagacgtacacatcgaccacagacacataccacgagcacacgcctacagtaggaactaggagacgccgtagagactcgtaggacgaacgaccggtaccgtatacgttttcgcggacgtacggaacggtaacggtaaaccggttaaaaggttcggtaaccgggttaagggtaacgggtttaccggggggactaacgacgttacggaaccgtacccgggg

SEQ ID NO: 440787 - DNA, 601 bp, Homo sapiens
  misc_feature: GZ8MTXP02G3U9W.10.88.H11.1.454.CMB.2.raw
  modified_base (282)..(282): a, c, t, g, unknown or other
  modified_base (351)..(351): a, c, t, g, unknown or other
  modified_base (360)..(360): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggcttggaggtggggtggggtggtcaggcgtacttacgaggttggactanactaaattngacacagtaacgttccagggacaggacgtcaaccatacgacccacacgacacactaccaacgacgacacacgacctacataggaacgtaggacggagaccgtagagacgtcgtacgaacgacgaccggtaccgtacttactttacgtcggtacgaccggaaggaacggtaaacggtaaaaggtacggtaacggtaagggttacggttaccgggggactacgacgtacggacgaacccgggg

SEQ ID NO: 440788 - DNA, 658 bp, Homo sapiens
  misc_feature: GZ8MTXP02IJKX1.10.88.H11.1.454.CMB.2.raw
  modified_base (287)..(287): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctgagtgaagatctcctgcgaggtcttcgtggttacacctttaacacctatggcatctccgtgggtcncgacacggcccctggacaggacttggaggtggggtggggtggtcaggccgtcttaaccgaaggtttcggaccttaaacgaactaaaatttacgtacggactaaaccgtaaaggtaaaccggtttcccgaagggggtaccaaaggtaacggttaccaacccgtagtacgaaacccaacgacgaaccacactaccaacgacgaccaacacgacctaacagtagaaacgtggacggacgtccgtagagacgtcgtagacgacgacggtaccgtattaacgtttcgtcgtaccggacgaacggaacgtaacgtaaaacggtgtaacggttaaggtacggttaccgggggaacaacgtacgtacggaacgtaccgg

SEQ ID NO: 440789 - DNA, 631 bp, Homo sapiens
  misc_feature: GZ8MTXP02JB2K8.10.88.H11.1.454.CMB.2.raw
  modified_base (283)..(283): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctccgtgcgaggtcttctggttacacctttaacacctatggcatctcctgggtncgacacggcccctggacaaggacttgaggtgggtgggtggtcagcgcttacgaggttgctacacaaaattcgngacacagtaacgtcgaggacagactacacatacgaccaacaagaccactacaccgaacgacgaccaacacgtacctaacagtaggaacgtaggacggacgacgtaggaacgtacgtacgtacggaacggaaccgtaccggtaaccgttacgttacgtttacggtacggaccggacgggtaaacggaaacggtaaaacggtaaaacggtacggtaacggttaacgggtaacggggttaccgggggaactaacgtaacgtacggaaccggtaccggg

SEQ ID NO: 440790 - DNA, 549 bp, Homo sapiens
  misc_feature: GZ8MTXP02JBHHM.10.88.H11.1.454.CMB.2.raw
  modified_base (340)..(340): a, c, t, g, unknown or other
  modified_base (346)..(346): a, c, t, g, unknown or other
  modified_base (350)..(350): a, c, t, g, unknown or other
  modified_base (471)..(471): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtggggtgggtggtcagcgcttacagttgctanacaatngcanagaagttcaggacagagtcacatcgaccacagacacactaccacgacgacacacgacctacagtaggaactaggaggagaccgtagagatcgtagacgacgacggtaccgtatactttacngcgacggagaacgaacgtaaaacggtacgtacggtaaggtacggttaccgggggactacgacgtacgacgtaaccggg

SEQ ID NO: 440791 - DNA, 596 bp, Homo sapiens
  misc_feature: GZ8MTXP02IDLUC.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctccgtgggtgcgacacggcccctggacaggcttgaggtggggtggggtggtcagcgtacttaccgaaggttggctaacactaaaattagtcgacactaaggaacgttccagggtacagacgtccaccatcgacccacagacacactaccaacgagacacacgacctacataggactaggaggagaccgtagagtactacgtacgaacgaccgacggtaccgtattacttttcgacgtcggacgtaaaggacggtaaacggtaaaaggttcgacgggttaaggtacggttaccgggggacaacgtacgtacggaccgaccgggg

SEQ ID NO: 440792 - DNA, 632 bp, Homo sapiens
  misc_feature: GZ8MTXP02HJA8Z.10.88.H11.1.454.CMB.2.raw
  modified_base (282)..(282): a, c, t, g, unknown or other
  modified_base (287)..(287): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttctgttacacctttaacacctatgcatctcgtgggtncgacncggcccctggacaggacttggaggtggggtggggtggtcaggcgtcttaccgaaggttggctaacaactaaattatgacaacgagtaacgttccgaggacagacgtaccaaccatacgaacccacacgaacacacgtaccaacgagacacacgacctacacgtacggaacctaggacggaacgaccgtaggaacgacgtacgtacgaaccgaaccgaccggtaccgttaattacgtttcgtacggacgacggaaggaaacggtaaacggtaaaaggtacggtaacgggttaacgggtaacgggttaccgggggaactaacggtacgtacggtaaccgaaccgggg

SEQ ID NO: 440793 - DNA, 581 bp, Homo sapiens
  misc_feature: GZ8MTXP02JT2FJ.10.88.H11.1.454.CMB.2.raw
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtgggggcctcagtgaagatctcctgcgaggcttctggttacacctttaacacctatggcatctccgtgggtgcgacacggcccctggacaaggctgaggtggggtgggtggtcagcgctacagttgctacactaatngcacagacgttcaggacagagtcacatacgaccacagacacatccacgacgccacacgacctacagtacgggaactaggaacgggacgaccgaggacggaacttccgtacggaccgaaccgaccggtaccgttaagttactttcgacgtcgaccgaaggaacgtaaacgtaaaagtcggtaacggtaaggttacgggttaccgggggacacgtagacgaaccgtaaccggg

SEQ ID NO: 440794 - DNA, 637 bp, Homo sapiens
  misc_feature: GZ8MTXP02GQ5G4.10.88.H11.1.454.CMB.2.raw
  modified_base (358)..(358): a, c, t, g, unknown or other
  modified_base (392)..(392): a, c, t, g, unknown or other
  modified_base (400)..(400): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcaacagcaacaggtgcccactcccaggttcagctggtgcagtctggggctgaggtgaagagccctggggcctcagtgaagatctcctgcgaggcttctggttacacctttaacacctatggcatctcctgggtcgcgacacggcccctggacaaggacttggaggtggggtggggtggtcaggcgcttacgagttggactacactaattangcacagacgtcgaggcagagtcacatacgaccanagacacanaccacgagacacagacctaacatacggaaacgtggaaggacgacgtaggagactcgtacggaaccgtaccgaaccgggtaccgttaacgttacgtttaccgttacggtacggaccggaagggtaaacggtaaacgggttaaaaaggtacgggtaaacgggttacggggttaaccggggttacccggggggtaaacctacggtaaacgttaccggaaccggtaacccggtaccggggg

SEQ ID NO: 440795 - DNA, 612 bp, Homo sapiens
  misc_feature: GZ8MTXP02HFVLU.10.88.H11.1.454.CMB.2.raw
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctccgtgggtgcgacacggcccctggacaaggcttggaggtggggtggggtggtcaggccgtcttaccgaaggttcggactaacgaactaaaattntagcaacgagtaaacgttcccaggggtaccaaggtacgtaccaaccctagtacgaacccaaacacgaaccacaactaccaacgacgacaacacgaccctacagtacggaaactggacggagccgtagagactcgacgaacgacgacggtaccgttagttaactttcgtgacgacgaagaaacgaacgtaaaacggtggaacggtaaggtacggttaccgggggacacgacgtacgacgaccggg

SEQ ID NO: 440796 - DNA, 622 bp, Homo sapiens
  misc_feature: GZ8MTXP02IZZ9F.10.88.H11.1.454.CMB.2.raw
  modified_base (244)..(244): a, c, t, g, unknown or other
  modified_base (286)..(286): a, c, t, g, unknown or other
  modified_base (350)..(350): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttntggttacacctttaacacctatggcatctcctgggtgcgacnggcccctggacaaggcttgaggtggggtggggtggtcagcgcttacagttggctacacaattangacacagaacgttccaggacagacgtcacatgaccacagacacactaccacgacgacacacgacctacagtaggaaacctaggaacggacgacccgtaggaacgtacgtaccgtacgaaccggaaccgaccgggtacccgttaagttaacgttttcgacggtaccggacggaaaggtaacggtaaaccggtaaaaggttacggtacgggttaaggggttaaccgggtttaccggggggaaccacgtaacggttacggaaccgtaacccgggg

SEQ ID NO: 440797 - DNA, 532 bp, Homo sapiens
  misc_feature: GZ8MTXP02FMTW9.10.88.H11.1.454.CMB.2.raw
  modified_base (354)..(354): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggcttgaggtggggtggggtggtcagcgcttaccgaagttggctacacaaattntgcacagaagttccggganagagtcaccatcgaccacagacacatccacgagcacacgacctacataggaaactgaaggagcctgagatcgtgacgacgacggccgtatattcgtgcgcgagagaacgtaaagtagacgtaggtaagttcgggggacacgagtcgacgacgtacgggg

SEQ ID NO: 440798 - DNA, 612 bp, Homo sapiens
  misc_feature: GZ8MTXP02JN05N.10.88.H11.1.454.CMB.2.raw
  modified_base (207)..(207): a, c, t, g, unknown or other
  modified_base (283)..(283): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcgagtgaagatctcctgcgaggcttctggttacacctttaacacctatggcatctcgtgggtncgacacggcccctggacaaggcttgaggtggggtggggtggtcagcgtacttacgagtgactaacactaaattgtgacacgagaacgttcgaggacagacgtcacatacgaccacagacacactaccacgacgaccacacgacctacaacgtaggaaacgtggacggacgccgtaggaagtacgtacgtacggaccgacgtacgggtacccgtaagttaacgtttcgtacgaccggacggaaaggaaacgtaaaccggtaaaaggtcggtaacggtaagggtaaccgggttaccgggggaacaacgtaacggtacgaccgtacccgggg

SEQ ID NO: 440799 - DNA, 636 bp, Homo sapiens
  misc_feature: GZ8MTXP02IBN9N.10.88.H11.1.454.CMB.2.raw
  modified_base (283)..(283): a, c, t, g, unknown or other
  modified_base (347)..(347): a, c, t, g, unknown or other
  modified_base (352)..(352): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtcgtggggctggaggtgaagagcccgtggggcctcgagtgaagatctctgcgaggcttctggttacacctttaacacctatgcatctccgtgggtncgacacggcccctggacaaggcttggaggtggggtgggtggtcagcgacttacagtgactacanaattngcanagattccaggcagcgtacaccatacgaccacagacacacacccaacgagacacacgacctacagtacggaactaggacggtacgccgtaggagtacgttacgacggaaccgaccgtaaccgggtacccgttaaagttaacgttttccgacggtaccgggaaccgtaaaggggtaaacggtaaaaccggttaaaaggttacgggtaacgggttaacggggttaacggggtttacccggggggaacaaccggtaacgttaccgggaacccgtaacccggggg

SEQ ID NO: 440800 - DNA, 705 bp, Homo sapiens
  misc_feature: GZ8MTXP02IQLJE.10.88.H11.1.454.CMB.2.raw
  modified_base (210)..(210): a, c, t, g, unknown or other
  modified_base (284)..(284): a, c, t, g, unknown or other
  modified_base (371)..(371): a, c, t, g, unknown or other
tcagcatagtagtgcacgaccggtgctcgatttagcgacagcgagaacacacaaagggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagngcccgtgggcctgagtgaagatctctgcgagtcttcgtggttactacctttaacacctagtgcatctcgtggcncgacgcggccctaggacaggtcgttggagggtggggtggggtggtcaggcgtacttaaccgaggttcgactaaacaactaaattcgngacaagaagtaacgttccgagggtaacaggacgtaccaacgtagacgaacccaacgaacgaaccaacactaccgaaacgacgaccaacgacgtacctaacgaacgtacggaaacgtaggaacgggacgtaccgtaggaaacgtacgtaccggtaacggaacccggaacggtaacccgggttaccgttaacgttaaccgtttcggtacggaccggaaccggtaaaagggtaaacggtaaaacgggttaaaacggtaacgggttaacggggttaacggggttaaccggggttaaccgggggaccaacggtacggtaccggaaccggtacccggggg

SEQ ID NO: 440801 - DNA, 525 bp, Homo sapiens
  misc_feature: GZ8MTXP02HUFQV.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgcacggcccctggacaaggacttgaggtggggtggggtgggtcaggcgcttaccaagttggctacacaaattatgcacagaacgttcaggacagagtcacatgaccacagacacataccacgagacacacgcctacataggaactagaggagcctagagagtctacgacgacacggacgtattattctgcgcgagagacgtaaagtgagtggtacgtcgggggacacgactacgacgtaccgg

SEQ ID NO: 440802 - DNA, 599 bp, Homo sapiens
  misc_feature: GZ8MTXP02GLJAZ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacaggcccctggacaaggacttggagtggggtggggtgggtcaggcgcttaccgaaggttggactacacaaattatgacacagaagttccagggacagacgtcaccatgaccacagacacactaccacgagccacacgcctaacagtacggaactaggaggacgccgtaggacgaacgttcgacggaaccgacgaccggtaccgttaagttacgtttcgtaggaccgacggaagaacggtaaacggtaaaacggtcggtaacggtggggtaacgggtttaccgggggaacacgtacgtacggaccgtaaccgggg

SEQ ID NO: 440803 - DNA, 557 bp, Homo sapiens
  misc_feature: GZ8MTXP02GCM76.10.88.H11.1.454.CMB.2.raw
  modified_base (283)..(283): a, c, t, g, unknown or other
  modified_base (355)..(355): a, c, t, g, unknown or other
  modified_base (402)..(402): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaggcttggaggtggggtggggtggtcagcgtcttacgaagttgctacactaattngacaacagaacgttccaggacagagtaccacatcgacacagacacanaccagacgacacacgacctacagtacggaactaggaacggacgacctaggagaacttcgacgacgacgacggtaccgtattacttcgtcgcgacgagaacgtaacgtaaagtgtaggtaaggtacggtacggggacacgacgtacgacgtaccgg

SEQ ID NO: 440804 - DNA, 535 bp, Homo sapiens
  misc_feature: GZ8MTXP02F4VOQ.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacaccttaacacctatggcatctcctgggtgcgacaggcccctggacaaggcttgagtgggtggggtggtcagcgcttaccaagttgctacacaattatgcacagaattccaggacagagtcacatgaccacagacacactccacgagcaacacgcctacatacgaaactgaggagcctagagactcgtagacgacgacggaccgtagtattcgtgcgcgaaggagaacgtaaaagagtacggtaaggtacgtaccgggggtacacgacgtacgacgtaacccggg

SEQ ID NO: 440805 - DNA, 567 bp, Homo sapiens
  misc_feature: GZ8MTXP02GCRJH.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttacacctttaacacctatggcatctctgggtgcgacacggcccctggacaaggacttgaggtggggtggggtggtcaggcgcttaccgaaagttggctacacaaattatgacacagaacgttccagggacaggacgtcaccatcgaccacagacacatccacgacgcacacgcctacacgtaggaactggaacggagccgtaggagatacgtgacgacgacggccgtagtactttcgtgcggtacgaacggtacggaaccgtaaaaggtgaacggtaagggtacgttaccgggggacacgagtacgaccgtaccgggg

SEQ ID NO: 440806 - DNA, 570 bp, Homo sapiens
  misc_feature: GZ8MTXP02GF4NP.10.88.H11.1.454.CMB.2.raw
  modified_base (280)..(280): a, c, t, g, unknown or other
  modified_base (349)..(349): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcctggggcctcagtgaagatctcctgcgaggcttctggttacacctttaacacctatggcatctcctgggtncgacacggcccctggacaaggcttggagtggggtgggtggtcagcgcttacgagttgctacacaaattngacacagaagttccaggacagacgtcaccatcgaaccacagacacactacccaacgacgcacacgacctacatacggaactggacggagaccgtaggagtactcgtaggaacgacgaccggaccgtagttaactttcgtagcggacgaacggaagtaaacgtaaaacgtggtacggtaacgggtacggttaccgggggacacgacgtacgacgaacccggg

SEQ ID NO: 440807 - DNA, 626 bp, Homo sapiens
  misc_feature: GZ8MTXP02HJUOH.10.88.H11.1.454.CMB.2.raw
  modified_base (283)..(283): a, c, t, g, unknown or other
  modified_base (288)..(288): a, c, t, g, unknown or other
  modified_base (363)..(363): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtcncgacncggcccctggacaaggacttggaggtggggtggggtggtcaggcgtcttaaccgaaggttggactacacaaattngacaacagaacgttccagggacagataccaaccatcgaacccacaacgacacactaccacgacgaccacacgacctacacgtacggaacgtaggacggacgaccgtagagactcgtacggaaccgaacgaaccggtaccgtaattacgtttacgtacggcggacggtaacggaaacggtaaacggtaaaaggtacggtaacggttaacgggttaacgggttaccgggggaacctaacgtacggtacggaaccgtaacccgggg

SEQ ID NO: 440808 - DNA, 604 bp, Homo sapiens
  misc_feature: GZ8MTXP02IAUIR.10.88.H11.1.454.CMB.2.raw
  modified_base (278)..(278): a, c, t, g, unknown or other
  modified_base (356)..(356): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctgggcatccttttcttggtggcagcagcaacaggtgcccactcccaggttcagctggtgcagtctggggctgaggtgaagagcctggggcctcagtgaagatctcctgcgaggcttctggttacacctttaacacctatggcatctcctgggtncgacacggcccctggacaaggacttggaggtggggtggggtggtcaggcgcttaccgaagttggctacactaaattcngcacagaacgttccaggcagacgtcaccatcgaccacaacgacacactaccacgacgacacacgacctacagtacggaaactacggaaggacgaccgtaggaggaactcgtagaccgaccgaacgggtacccgttatacgtttcgttcggacggcggaacggaaacggtaaacggtaaaaggtacggtaacggttaggggtaacggttaccgggggaacaccgtagtacggaccgaccggtacggggg

SEQ ID NO: 440809 - DNA, 666 bp, Homo sapiens
  misc_feature: GZ8MTXP02JJ8UA.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttcgtggttactacctttaacacctatggcatcctccgtgggtcgcgacacggcccctaggacaaggtcttggaggtggggtggggtggtcaggcgtcttaccgaaggttggactaacgaactaaattatgacaacgtagtaacgttccgaggggacaaggtacgtaccaaccagtacgaacccacaacgacacactaccacgacgacacacgaccacagaggaaccgtaggaaggacgtaccgtaggaagtactacgtacggaccgaaccggaccggtaccggttaattacgtttcgacggtaccggaccgggaaagtaaacggtaaacggtaaaacgggtacggtaacgggttaacggggttacggggttaacccggggggaactaaccggtaacggtaccggaaccggtaaccccggggg

SEQ ID NO: 440810 - DNA, 538 bp, Homo sapiens
  misc_feature: GZ8MTXP02JQ2RW.10.88.H11.1.454.CMB.2.raw
  modified_base (282)..(282): a, c, t, g, unknown or other
  modified_base (407)..(407): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctcctgggtncgacaggcccctggacaaggacttgaggtgggtggtgggtcaggcgcttaccgaagttggactacacaaattatgcacagaagttccaggacagagtcaccatgaccacagacacataccacganacacagcctacatagactggaggagcctagagatctaggacgacgacggccgtatactttcgtagcgacgagaacgacgtaaagtcgacgtaaggtacggttaccgggggacacgactacggacgtaccgg

SEQ ID NO: 440811 - DNA, 564 bp, Homo sapiens
  misc_feature: GZ8MTXP02GPKQ9.10.88.H11.1.454.CMB.2.raw
  modified_base (283)..(283): a, c, t, g, unknown or other
  modified_base (288)..(288): a, c, t, g, unknown or other
  modified_base (355)..(355): a, c, t, g, unknown or other
  modified_base (406)..(406): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctccgtgggtncgacncggcccctggacaaggcttggagtggggtggggtggtcagcgcttacgaggttgctacactaaattngacacagtaagttccagggaccaggacgtccaccatcgaccacagacacanccacgagcacacgctacataggaactggaggacgctaggagatcgtagacgaacgacggtaccgtagttactttcgtggcgacggaaaggacggtaacggtaaaaggtggtaacggtgggtacggtaccgggggtacacgtacgtacgacgtaccggg

SEQ ID NO: 440812 - DNA, 588 bp, Homo sapiens
  misc_feature: GZ8MTXP02F6JCG.10.88.H11.1.454.CMB.2.raw
  modified_base (354)..(354): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggcccctggacaaggcttggaggtggggtgggtggtcagcgcttacgaagttggctacacaaattngcacagtaacgttccagggacaggagtaccaccagtcgaccacagacacactaccacgacgacacacgacctacacgtaggaaactaggacggacgccgtagacgactcgtagaccgaccgacggaccgtagttacgtttcgacggtcgacggaagaacggtaacgtaaaacggtcggtacggtaaggttaacgggttaccgggggaactacgacgtacggaccgtaacccggg

SEQ ID NO: 440813 - DNA, 619 bp, Homo sapiens
  misc_feature: GZ8MTXP02GV9M3.10.88.H11.1.454.CMB.2.raw
  modified_base (289)..(289): a, c, t, g, unknown or other
  modified_base (544)..(544): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtcgtggggctgaggtgaagagccctggggcctcgagtgaagatctcctgcgaggtcttctaggttaaccacctttaacacctatggctatctccgtgggtcncgacacggcccctaggacaaggtcttggaggtggggtgggtggtcaggccgtacttaaccgaaggtttcggacctaaacgtaactaaaacttttgacgacctaaacgtaggtaaacggttcccgaggggaccaaggtacgtaccaaccgtagtcgaaacccacgaagaccaacacacacgacgcacacgacctacagtaggactaggaggacgctagagacgtacgacggacgacgacggtacgtattagttcgngacgacgaagaacgtaacgtaacgtacggtacggtaacggtacggtaccgggactacgtacgtacgaccgtacgg

SEQ ID NO: 440814 - DNA, 625 bp, Homo sapiens
  misc_feature: GZ8MTXP02IVVFW.10.88.H11.1.454.CMB.2.raw
  modified_base (208)..(208): a, c, t, g, unknown or other
  modified_base (364)..(364): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagngcccgtggggcctcgagtgaagatctcctgcgaggtcttctggttacacctttaacacctatggcatctccgtgggtgcgacacggcccctaggacaaggcttggaggtggggtggggtggtcaggcgtcttaccaaggttgctacactaaattangacacgagtaacgttccagggtacaggtacgtaccaaccgatacgaacccacgacgaaccacgactaccgacgaacgacaaccgaacgaccctaacagtaacggaaacgtggaaggacgtaccgtaggaacggacttacgtacggaaccgaaccggaccgggtaccttaagttacttcgtcggacgacggtaaggaacgtaacgtaaaagtcggtacggtaaggttacggtacgggggacagtacgtacggacgtaccggg

SEQ ID NO: 440815 - DNA, 693 bp, Homo sapiens
  misc_feature: GZ8MTXP02IW8EV.10.88.H11.1.454.CMB.2.raw
  modified_base (363)..(363): a, c, t, g, unknown or other
  modified_base (368)..(368): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtgacagcagcaacaggtgcccactcccaggttcagctggtgcagtctggggctgaggtgaagagcccgtggggcctcagtgaagatctcctgcgaggtcttctggttacacctttaacacctatggcatctccgtgggtcgcgaccaggccccctggacaaggcttggaggtggggtggggtggtcagcgcttacgaagttggactacactaaattatnactanagtaacgttccagggaccagacgtaccaccgatacgaaccaacagaaccacactacccaagacgaccaaacgacgtaccctaacgacgtaacggtaaaccgtaggaagggacgtacccgttagggaacgtaacgttccgtacgggaaccgtaaccgaccggggttaaccgttattacgtttttacgtcggaccggtccggaaaggaaacggttaaaccgggttaaaaaaggttcggggtaaaacggggttaacggggttaaaccggggtttacccggggggaaaccgaaaccggtaacggttacggaaccggttaaccccggggg

SEQ ID NO: 440816 - DNA, 552 bp, Homo sapiens
  misc_feature: GZ8MTXP02IAY0T.10.88.H11.1.454.CMB.2.raw
  modified_base (281)..(281): a, c, t, g, unknown or other
  modified_base (455)..(455): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctgggctggaggtgaagagcccgtggggcctcagtgaagatctcctgcgaggcttctggttacacctttaacacctatggcatctcctgggtncgacacggcccctggacaaggtacttggaggtggggtggggtgggtcaggcgtcttaaccgaggttggactacgacaaattatgcacgagaagttcccaggacagacgtccaccatcaccacagacacactaccacgagacacacgacctacataggactgaggagctagagancgtagacgacgacggaccgtatactttcacgtcgacgagacgaacgtaaagtaggacgtaaggtacgtaccgggggtacacgagtacgacgaccggg

SEQ ID NO: 440817 - DNA, 611 bp, Homo sapiens
  misc_feature: GZ8MTXP02JZRTM.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaacacctatggcatctccgtgggtgcgacacggcccctggacaaggcttgaggtggggtggggtggtcagcgcttaccgaagttgctacacaaattatgcacagacgttccaggacagatcaccatcgaccacacgacacatccacgacgacacacgcctacagtacggaacgtaggagggacgtaccgtagacgtatcgtacggaaccgacgaccgggtaccgtacgttaactttcgtacggccggacgaacggaacggtaaaccggtaaaaggtacggtaaccgggttaaggggttaaccgggttacccggggggtaacctaacggacggttacggaaccgtaacccgggg

SEQ ID NO: 440818 - DNA, 607 bp, Homo sapiens
  misc_feature: GZ8MTXP02I3YDM.10.88.H11.1.454.CMB.2.raw
  modified_base (357)..(357): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttacacctttaacacctatggcatctccgtgggtgcgacgacggcccctaggacaaggacttggaggtggggtggggtggtcagcgcttacagttgctacgacaattngacacagaacgttccagggacagacgtcacatcgaccacagacacactaccacgagacacacgacctacagtaggaactaggacggacgaccgtaggaagactacgtaggacggacgaccggtaccgtaattacgtttacgtcggacggacggaaaggaacggtaaacggtaaaacggttacggtaacggttaagggttaacgggttaccggggggaacaacggtaacgtacggtaaccgtaacccgggg

SEQ ID NO: 440819 - DNA, 552 bp, Homo sapiens
  misc_feature: GZ8MTXP02GV3JI.10.88.H11.1.454.CMB.2.raw
  modified_base (282)..(282): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacaggcccctggacaggcttggaggtggggtggggtggtcaggcgcttacaggtttggactacactaaattatgcaacagtaacgttccgagggacagacgtcaccatgacccacagaacacactaccacgacgccaacacgacctacatacggaacgtagaggacgcctagagactcgtacgacgacgacggccgtatattctgcgacgagaacgacgtaaagtcgaggtggtacggttacgggggacagacgtacgacgtaccggg

SEQ ID NO: 440820 - DNA, 543 bp, Homo sapiens
  misc_feature: GZ8MTXP02GVEYO.10.88.H11.1.454.CMB.2.raw
  modified_base (281)..(281): a, c, t, g, unknown or other
  modified_base (354)..(354): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctctgcgaggcttctggttacacctttaacacctatggcatctccgtgggtncgacacggcccctggacaaggcttgaggtgggtgggtggtcagcgcttaccgaagttggactacactaaattntgacacgagtaacgttccagggacagacgtcaccgatcgaccacagacacactcacgagacacacgacctacagtagaacgtgacgagctagagatcgtagacgacacggacgtatacttctgacgcgagacgacgtaaacgtcgtaacggtggtacggttaccggggacacgacgtacgacgtaccgg

SEQ ID NO: 440821 - DNA, 610 bp, Homo sapiens
  misc_feature: GZ8MTXP02GUM87.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcagtgaagatctcctgcgaggcttctggttacacctttaacacctatggcatctccgtgggtcgcgacacggcccctaggacaaggacttggaggtggggtggggtggtcgaggcgtcttaacgaaggttggctaacgactaaaattatgacacgaagtaacgttccaggggacaggacgtaccaccgatcgaaccacagacacactcaacgagacacacgacctacactaggaactagaggagccgtagagacgtacgtacgaccgacgaccggtaccgtagttactttcgacgcggacggaaggaacggtaaacgtaaaaggtcggaacggttaacgggtaacgggttaccgggggaacacgtacggtacggaaccgtaaccggggg

SEQ ID NO: 440822 - DNA, 666 bp, Homo sapiens
  misc_feature: GZ8MTXP02I27Z5.10.88.H11.1.454.CMB.2.raw
  modified_base (285)..(285): a, c, t, g, unknown or other
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttctggttactacctttaacacctatggcatctccgtgggtncgacacggcccctaggacaaggtcttggacggttggggtggggtggtcaggcgtacttaccgaagttcggactaacactaaattntgacaacgagaacgttccagggacagagtaccacatcgaaccacagacacactaccaacgagaccaacacgaccctacaagtacgggaaacctagggaacggtacgaccgtaagggaacgtacgttacgtaacggaaccggaaccgtaaccgggtacccgtttaaattaccgtttaccgtacggaccggacggtaaacggaaacggtaaaccggttaaaaaggtcggtaacgggttaacgggttaacggggttaccgggggaaactaacggtacgtacggaaccgtaacccggggg

SEQ ID NO: 440823 - DNA, 637 bp, Homo sapiens
  misc_feature: GZ8MTXP02GTR2A.10.88.H11.1.454.CMB.2.raw
  modified_base (281)..(281): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctctgcgaggcttctggttacacctttaacacctatggcatctcctgggtncgacacggcccctggacaaggacttggaggtggggtggggtggtcaggcgtcttaccgaaggttggactaacgacaaattatgcacagtaacgttccagggacaggacgtaccaccatacgaccacagacacactccacgagaccacacgacctacagtacggaactaggaacggagacccgtagacgacttacgacggaacgaacccgacggtaccgttaagttaacgtttccgtaggccggaccggtaaaggtaaacgggtaaacggttaaaacggtaggtaaccggggttaagggttaaacggggttacccggggggaactaacgaacggtacggtaacccggtaacccgggg

SEQ ID NO: 440824 - DNA, 541 bp, Homo sapiens
  misc_feature: GZ8MTXP02HQ54L.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggacttggaggtggggtggggtgggtcaggcgtcttaccaaaggttggactacgaactaaaattatgacacagaacgttcaggacagagtcaccatgaccacagacacatccacgagacacacgacctacactaggaactggaacggagccgagagagtcagacgacgacggccgtatattactgcgcgagagaacgtaaaagtgacgtggtagtacgggggacacgatacgacgaaccgg

SEQ ID NO: 440825 - DNA, 551 bp, Homo sapiens
  misc_feature: GZ8MTXP02H0W1C.10.88.H11.1.454.CMB.2.raw
  modified_base (359)..(359): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcctgggtgcgacacggcccctggacaaggacttggaggtggggtggggtggtcaggcgcttaccaagttgctacacaaatttangcacagaacgttccagggacaggacgtcaccatgaccacagacacatccagacgacacacgcctacataggaactgaggagcctagagagtcgagacgacgacggtaccgtattactttcgtgtcgacgagaacgaacgtaaaagtgacggttaaggtacggttaccgggggacacgacgtcgacgtaccgg

SEQ ID NO: 440826 - DNA, 770 bp, Homo sapiens
  misc_feature: GZ8MTXP02JPWNZ.10.88.H11.1.454.CMB.2.raw
  modified_base (571)..(571): a, c, t, g, unknown or other
tcagcatagtagtgcacgaccggtgctcgatttagcgacagcgagaacacacaaagggacccaaaaaccacaccctccttgggagaatcccctagatcacagctcctcaccatggactggacctggagcattccttttcttggtggcagcagcaacaggtcgcccactcccaggttcagctggtgcagtcgtggggctggaggtgaacggacgcccgtggggcctcgagtagaagtactctcgtgcgtacggtctttcgttacggttaacctaacccgttttaaacaccttagtcggactacgttccgttccggtgggtcgaccgtaccgaccggtccccgtaggaacgtaacggtcgtttagggagggtgggggttcggggtggttcgaggtacccgtacgtttaaccggtaaggttcgactaaacctaacgtaaaactttcgacgactaaacgagtaaacggttccaggaacgtagacgtaccaactagtaacaccaacacgaaccaacgacgaccacgacaccaacgaacgtacctaaacgagtaacggaacgtacggaacggtaccncgttagaacgtacgttccgaacggaaccgtacggtaccggttaacgtttacgttaacgtttccgacgggaccggtaaaccggtaaagggtaaacggttaaaaccgggttaaaagggccggtttaaacggggtaacggggttaacccgggttacgggggaacctaacggtaacggtaccggtaacccggtaacccggggg

SEQ ID NO: 440827 - DNA, 532 bp, Homo sapiens
  misc_feature: GZ8MTXP02GRDUJ.10.88.H11.1.454.CMB.2.raw
  modified_base (281)..(281): a, c, t, g, unknown or other
  modified_base (352)..(352): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacacggcccctggacaaggcttgaggtgggtggggtggtcagcgcttaccgaagttgctacacaaattntgcacagaagttccaggacagagtcaccatgaccacagacacactccaacgagacaacacgacctacataggaactagaaggagaccgtagagatcgtagacgacgacggacgtatattctgcgacgagagaacgtaaagtgacgtggtacgttacgggggacacgactacgacgaccgg

SEQ ID NO: 440828 - DNA, 559 bp, Homo sapiens
  misc_feature: GZ8MTXP02HBDDD.10.88.H11.1.454.CMB.2.raw
  modified_base (342)..(342): a, c, t, g, unknown or other
  modified_base (346)..(346): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggacttgaggtgggtgggtggtcagcgcttacagttgctacanaatngcacagaagttccaggacagacgtcaccatacgaccacagacacataccaacgagacacacgcctacactaggaactagaggacgccgtagacgatcgtacgacgacgacggaccgtatacttacgtgacggacgaggaacgtaacggtaaaagtcggaacggttaacggtacggttaccggggggaactaaccgacgtacggaccgtaccgg

SEQ ID NO: 440829 - DNA, 615 bp, Homo sapiens
  misc_feature: GZ8MTXP02IPYX8.10.88.H11.1.454.CMB.2.raw
  modified_base (208)..(208): a, c, t, g, unknown or other
  modified_base (291)..(291): a, c, t, g, unknown or other
  modified_base (374)..(374): a, c, t, g, unknown or other
  modified_base (441)..(441): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattccttttcttggtggcagcagcaacaggtgcccactcccaggttcagctggtgcagtcgtggggctggaggtgaagngcccgtgggggcctcgagtgaagatctcctgcgaggcttcgtggttaaccacctttaacacctagtggcatctccgtgggtcncgacacggcccctaggacaaggcttggaggtggggtggggtggtcaggcgtacttaccgaggttgctaacaacaaatttacgngacaacgagtaacgttcagggacaaggacgtaccaacatacgaaccacacgacaacactaccacganacaacacgaccaacgagaggaaactggaacggacgccgtagagatcgaggaacgacgaccggtacgtaattacgtttcgacggcggacgaaaggaacgtaaaacggtaaagtacggtaacggtaacgggttaacgggtacgggggacaacgtacgtacggtacgtaacccgggg

SEQ ID NO: 440830 - DNA, 552 bp, Homo sapiens
  misc_feature: GZ8MTXP02HSU4X.10.88.H11.1.454.CMB.2.raw
  modified_base (283)..(283): a, c, t, g, unknown or other
  modified_base (374)..(374): a, c, t, g, unknown or other
  modified_base (412)..(412): a, c, t, g, unknown or other
  modified_base (447)..(447): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctccgtgggtncgacacggcccctggacaagggtacttggaggtggggtggggtggtcaggcgactttaaccgaaggttggacctaacaacgtaaaattagngacaacaggaaacgttccagggacagacgtccaaccanacaccacacgacacacacacgagacacacgactanagagaacgtagaggagacgagagagcagacgacgacgacgtatattcagcgacagaagaacgaagtagacgtaaggacggtacgggacacgacgtacgacgacgg

SEQ ID NO: 440831 - DNA, 518 bp, Homo sapiens
  misc_feature: GZ8MTXP02G1CJ5.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttggagtgggtgggtggtcagcgcttaccaagttggctacacaaattntgcacagaagttccagggacagagtcaccatcgaccacagacacactccacgagcacacgcctacataggactgaggagcctgagatctgacgacgacggccgtatattctgcgcgagagacgtaaagtgacgtggtacgtacggggacacgactacgacgtaccgg

SEQ ID NO: 440832 - DNA, 544 bp, Homo sapiens
  misc_feature: GZ8MTXP02GXMH3.10.88.H11.1.454.CMB.2.raw
  modified_base (281)..(281): a, c, t, g, unknown or other
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggcttgagtgggtgggtgggtcagcgctaccgaagttggctacgacaaattngcacagaacgttccagggaccagacgtcaccatacgaccacagaacacactaccaacgagacacagacctacataggactgaaggagacctaggagactcgagacgacgtacggaccgtatactttctagcgacgagacgtaacgtaaaacgtgaacgtggtacgtacgggggactacgatacgactaccggg

SEQ ID NO: 440833 - DNA, 628 bp, Homo sapiens
  misc_feature: GZ8MTXP02FGH5U.10.88.H11.1.454.CMB.2.raw
  modified_base (283)..(283): a, c, t, g, unknown or other
  modified_base (358)..(358): a, c, t, g, unknown or other
  modified_base (388)..(388): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttctggttaccaccttaacacctatggcatctccgtgggtncgacacggcccctggacaaggcttgaggtggggtggggtggtcagcgctacgaagttggactacaactaaattangacacagaagttccaggacagagtcaccancgaccacagacacataccacgacgacacgacgacctaacacgtacggaaacgtaggaacgggacgaccgtaggagacgtacgtacggaaccggaccgaaccgggtaccgtaacgttacgtttaccgtacggccggacggaaacggaaacggtaaaccggttaaaaaggtcggtaaccggtaacggggttaacggggttaccggggggaacctaacggtacgtacggaccgtaacccgggg

SEQ ID NO: 440834 - DNA, 672 bp, Homo sapiens
  misc_feature: GZ8MTXP02JZSGA.10.88.H11.1.454.CMB.2.raw
  modified_base (286)..(286): a, c, t, g, unknown or other
  modified_base (363)..(363): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggtcttctggttacacctttaacacctatggcatctccgtgggtcncgacgacggcccctggacaggcttggaggtggggtggggtggtcaggcgacttacgaagttcgctacgactaaattngacacagtacgttccagggacagagtcaccatcgacacagacacactaccacgacgaccacacgacctaacgacgtacggtaaacctaggaacggtacgaccgttaggaacgtactacgtacggaaccgaaccggtaccggtacccgttaagttacgttttaccggcggaccggaacgggtaaacggtaaacgggtaaaaccgggttaaaacgggttacgggtaaccgggttaacgggggttaaaccggggttacccggggggaaactaaccggtaacggttaccgggaacccggttaaaccccggggg

SEQ ID NO: 440835 - DNA, 587 bp, Homo sapiens
  misc_feature: GZ8MTXP02HGP43.10.88.H11.1.454.CMB.2.raw
  modified_base (360)..(360): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggacttgagtggggtggttgggtcaggcgacttaccgaagttggactaacacaaaattangcacaagaagttccaggacagagtcaccatacgaccacagacacactcacgacgacaacagacctacacgtaggaaactagacggagaccgtaggagaactcgtacgacgaacgaccggtaccgtaattaactttcgtcggcggtacggaaggaacggtaacgtaaaaacgtaggtaacggtaagggttacggttaccgggggacacgacgtacggacgaacccggg

SEQ ID NO: 440836 - DNA, 654 bp, Homo sapiens
  misc_feature: GZ8MTXP02HKOA4.10.88.H11.1.454.CMB.2.raw
  modified_base (359)..(359): a, c, t, g, unknown or other
  modified_base (437)..(437): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcagtgaagatctcctgcgaggcttcgtggttacacctttaacacctatggcatctcctgggtgcgacacggcccctggacaaggacttgaggtgggtggtggtcagcgtcttaccgaagttcggctacaacaattacngcacaagaagttccagggtacagagtacaccagtacgaacccacaagaaccacatcccaacgagacacacgaccctanaagtaggaactgaacgggagaccgtaggaagtacgtacgtacggaacgacgaaccgggtaccgttaagttaacgtttccgtacggccggtaaccggaaggtaaacggtaaaaccggttaaaaacggtaagggtaaccgggttaacggggttaaccgggttaaccgggggggtaaaccgaaccgtaacggttaccggaaacccggtaaaccccggggg

SEQ ID NO: 440837 - DNA, 645 bp, Homo sapiens
  misc_feature: GZ8MTXP02G3BMV.10.88.H11.1.454.CMB.2.raw
  modified_base (290)..(290): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctcagtgaagatctccgtgcgaggtcttcgtggttaccacctttaacacctagtgcatctcgtgggtncgacacggcccctaggacaaggtcttggaggtggggtggggtggtcaggccgtacttaaccgaaggttcggactaacgaaactaaattacgtcgacaacgtaggtaaacgttcccgagggaccagtaacgtccaacgtagacgaaccaacgaacacaacacaccgaacgacaccaacacgacctaacgagtacgaacgtaggaagacgacgtaggaagacgtacgacgacgaacgtaccgtacgtacttacgttacgtcgacgacgaaggtaaacggtaaacgtaaaggtacggtaacgggttaacgggtaacgggtaccgggggaacgtacgtacgtacggtaaccggtaccgg

SEQ ID NO: 440838 - DNA, 604 bp, Homo sapiens
  misc_feature: GZ8MTXP02I2XOK.10.88.H11.1.454.CMB.2.raw
  modified_base (367)..(367): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttctggttactacctttaacacctatggcatctcctgggtgcgacaggcccctaggacaaggcttggaggttggggtggggtggtcaggccgtcttaccgaaggttggctaacacaaatttanagcacgagtaacgttccgaggacagtacgtacaccagtcgaccaacagacacactaccacgagcacagcctacagtacggaactggacggagacctagacgactcgtaggaccgaacgaccggtacgtagttacttacgtcgacggaccggtaaagaacggtaaacgttaaaaggtcggtaacggtgggttaacgggttaccggggggactaagtacgtacggaaccgtacccgggg

SEQ ID NO: 440839 - DNA, 602 bp, Homo sapiens
  misc_feature: GZ8MTXP02J3BJU.10.88.H11.1.454.CMB.2.raw
  modified_base (161)..(161): a, c, t, g, unknown or other
  modified_base (184)..(184): a, c, t, g, unknown or other
  modified_base (272)..(272): a, c, t, g, unknown or other
  modified_base (279)..(279): a, c, t, g, unknown or other
  modified_base (294)..(294): a, c, t, g, unknown or other
  modified_base (299)..(299): a, c, t, g, unknown or other
  modified_base (336)..(336): a, c, t, g, unknown or other
  modified_base (366)..(366): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtncccactcccaggttcagctggtncagtcgtgggctggaggtgaagcgcccgtggggcctcgagtgaagattcctaccgtgcgaggtctttctcggtttaccacctttaacnccttagngcatctccgtgggtncgacncggccctggacaggtacttgaggtggggtgggtgtcngcgtactaccgagttgactacgaactaatngacaagagagttccgaggacaagcgtacacgataccgacacacgactacacaccacgagaccacacgacctagagtacggactggacggacgcgtagatacgtccgtaggaaccgtacggtacgggtaccttaaacgttctttacgacggacggtaaccggaaggtaaacgtacgtaaaacggttcggaacggttaacggtacggtaccggggacacgtacgacgaccgtaccggg

SEQ ID NO: 440840 - DNA, 619 bp, Homo sapiens
  misc_feature: GZ8MTXP02H16QN.10.88.H11.1.454.CMB.2.raw
  modified_base (196)..(196): a, c, t, g, unknown or other
  modified_base (270)..(270): a, c, t, g, unknown or other
  modified_base (299)..(299): a, c, t, g, unknown or other
  modified_base (306)..(306): a, c, t, g, unknown or other
  modified_base (310)..(310): a, c, t, g, unknown or other
  modified_base (428)..(428): a, c, t, g, unknown or other
  modified_base (442)..(442): a, c, t, g, unknown or other
  modified_base (535)..(535): a, c, t, g, unknown or other
tcagcatagtagtgcacgaccggtgctcgatttagcgacagcgagaacacacaaagggggaggaactgctcagttaggacccagagggaaccatggaagcccccagctcagcttctcttcctcctgctactctggctcccaggtaccaccggagagattgtgttgacgcagtcgccagcccaccttgtctttttcnccaggggacagagtccaccctctcctggtacgggcctagttatggtgttggcgtcttaattaactggtaccaanagaacgtggccaggctcccgagcctcctnatcagancacnccacgaggccacgtggcctccagccgtagggttcagtggctaggtgggtacctggggaactagtaccttacgactcctccgaacctagtaccgacgccgtaacgccgtaggggaaccnccgtaaggaaactnttaacgtgtacttaagttttactaagttcgtcaggctagtgtacgcgtagggtccgttacctttgaaccgggtttccgggaacccgggtaaanaaaggtgtaaaacacggtaaaacgagtttggacgtcgacggaccactagttctcgttacctcgtacttcctccccgatactacg

SEQ ID NO: 440841 - DNA, 603 bp, Homo sapiens
  misc_feature: GZ8MTXP02JXCE9.10.88.H11.1.454.CMB.2.raw
  modified_base (284)..(284): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctgggggccctcagtgaagatctcctgcgaggcttctggttacacctttaacacctatggcatctcctgggtncgacaggcccctggacaaggcttggaggtggggtggggtggtcaggcgcttaccgaaggtttggactacacaaattatgacaacaggaacgttccagggacaggagtacaccgatcgaccacagacacataccacgagaccacacgacctacagtaggaactaggacggagcctagaagagtcgtacgacgaccgaccggtaccgtaagttactttcgtacggacggaccggaaggagtaaaccggtaaaacggtcggtaacggttaagggttaacggttaccggggggactacgacgttacggaaccgtaacccgggg

SEQ ID NO: 440842 - DNA, 642 bp, Homo sapiens
  misc_feature: GZ8MTXP02IFM68.10.88.H11.1.454.CMB.2.raw
  modified_base (281)..(281): a, c, t, g, unknown or other
tcagcatagtagtgcacgaccggtgctcgatttagcgacagcgagaacacacaaaggggacccaaaaaccacacccctccttgggagaatccctagatcacagctcctcaccatggactggacctggagcatccttttcttggtggcagcagcaacaggtgcccactcccaggttcagctggtgcagtctggggctggaggtgaagagccctggggcctcagtgaagatctctgcgaggcttctggttacacctttaacacctatggcatctccgtgggtncgacacggcccctggacaaggcttggaggtggggtggggtggtcaggcgtcttaccgaagttggactacaactaaattatgacacgaagtaaacgttccagggacagacgtaccaaccagtacgaacccaacacgacaacactacccgaacgacgaccaacgacgacctaacgactaggaacctaggaagggacgaccgtaggaagtacgtacgttacggaccgaacgtaccgggaccggttaacttacgttttaccgtcggacggtacgaaaggaaacggtaacggttaaaaaggtcggtaacgggttaagggttaacgggttaccgggggactaacgacgttacgaaccgtacccgggg

SEQ ID NO: 440843 - DNA, 706 bp, Homo sapiens
  misc_feature: GZ8MTXP02JJ94A.10.88.H11.1.454.CMB.2.raw
  modified_base (208)..(208): a, c, t, g, unknown or other
  modified_base (283)..(283): a, c, t, g, unknown or other
tcagcatagtagtgcacgaccggtgctcgatttagcgacagcgagaacacacaaagggacccaaaaaccacacccctccttgggagaatcccctaaatcacagctcctcaccatggactggacctggagcattccttttcttggtggcagcagcaacaggtgcccactcccaggttcagctggtgcagtctggggctggaggtgaagngccctggggcctcagtgaagatctcctgcgaggtcttctggttacacctttaacacctatggcatctccgtgggngcgacacggcccctggacaggcttggaggtggggtggggtggtcgaggtcgtacttaaccgaaggtttcggacctaacgaaactaaatttacgtacgacctaacgaaggtaaacggttacccgaagggtaccgagggtaacgttaccgaaacccgtaagtaccggaaacccaacgaaacgaaaccaaccactaccgaacgaacgaccaaccaacgaccctaacgacgtacggaaacgtggaaacggacgaccgtaggaacgtacgtacgtacggaaccgaacggtaccggtaccgttagtttaacgtttccgtacggaccgtacggaaacgaaacggtaaaaccggttaaaaggtcggtaacggttagggttaaccgggttaccgggggaactaacgacgtacggacccgtacggtaccgggg

SEQ ID NO: 440844 - DNA, 616 bp, Homo sapiens
  misc_feature: GZ8MTXP02GEGPH.10.88.H11.1.454.CMB.2.raw
  modified_base (282)..(282): a, c, t, g, unknown or other
  modified_base (360)..(360): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctcgtgggtncgacacggcccctggacaaggacttggaggtggggtggggtggtcagcgcttacgaagttcggactacactaaattangacaacagtaacgttccagggacaggtagtccaccatcgaccacagaacacactccagacgcacacgacctacagtacggaaacgtaggaacggacgccgtaggaagagttacgaggaaccggaacgacccgggtaccgttagttaactttcgaggccggacggaaggaaacgtaaacggttaaaaacggtggtaacggttaaggggttaacgggttaaccggggggacacgaaacgtcggaaccgtaacccgggg

SEQ ID NO: 440845 - DNA, 536 bp, Homo sapiens
  misc_feature: GZ8MTXP02JEQ3J.10.88.H11.1.454.CMB.2.raw
  modified_base (350)..(350): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtcgcgacacggcccctggacaaggacttggagtgggtggggtggtcagcgcttacgagtgctacacaattangcacagacttcaggacagagtcacatacgacacagacacactaccacgacgcacacgcctacacgtaggaactggaacggtagccgtagagagtacgtagacgacgacggtcgtactactttcgtgcgacgagagacgtaaaggcgacggtggtacggtacgggggacacgacgtacgacgtacgg

SEQ ID NO: 440846 - DNA, 637 bp, Homo sapiens
  misc_feature: GZ8MTXP02ISHK9.10.88.H11.1.454.CMB.2.raw
  modified_base (287)..(287): a, c, t, g, unknown or other
  modified_base (349)..(349): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacnggcccctggacaaggcttgagtggggtgggtggtcagcgcttaccagttgctacataaattngcacagaacgttccagggacagacgtcaccatcgaaccacagacacactccacgagaccacaacgacctacagtacgtaaaccgtagagggacgcccgtaggaacgagtacgtcgaaccggaaccgaaccggtacccggttaattaacgttttcgtacgggtaccggaccggtaaaggaacggtaaaccggttaaaaacgggttacggtaaccggggttaacggggttaacgggtttacccgggggggaacctaaaccgtaggtacgggtaaccggtaaccccggggg

SEQ ID NO: 440847 - DNA, 713 bp, Homo sapiens
  misc_feature: GZ8MTXP02HC2DN.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaagacgcccgtggggcctgagtgaagatctccgtgcgaggtcttcgtggttacctacctttaacacctagtcggctactcctccgtggggtcgaccggacgaccgggccccctagggaaccgtaagggtaccgtttgggaggggttggggggttgggggtcgggttccgaggcccgtaccgtttaaccgtaggttcggacctaaacgaaacgtaaaagtttagtcgacaacgtaagtaacgttccgaggtacaagacgtaccaaccgataccgaacccaacgacgaacacaccgtaccaacgacgaccacacgaccacagtagaacgtggacggacgccgtaggatacgtacgtacggaaccgaccgacggtacctagttacgtttcgtacgaccggacgaacggaaacggtaaacgggtaaaacgtcgggtaaacgggttaacggggttacgggtaacccgggggtaacctaaacggtacgtaacggtaacccggtaacccggggg

SEQ ID NO: 440848 - DNA, 633 bp, Homo sapiens
  misc_feature: GZ8MTXP02I78J6.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaaggacttggaggtggggtgggtggtcagcgtccttaacgaggttggctaacgaactaaagttatgacaacgagtaacgttcaggacaggactcaccgatacgaccacagacacactaccaacgacgccaacacgacctaacagtacgggaaactggaaggacgccgtagaacgtacgtacgtacggaccgaaccgaccgggtaccgtaattacgtttccgtaggacccggacggtaacggaaaggtaaaccggttaaaaaggtacggtaaacggttaacggggtaaacggtttacccggggggaactacggaacgtacggaaccgtaacccggg

SEQ ID NO: 440849 - DNA, 623 bp, Homo sapiens
  misc_feature: GZ8MTXP02JVYA2.10.88.H11.1.454.CMB.2.raw
  modified_base (229)..(229): a, c, t, g, unknown or other
  modified_base (284)..(284): a, c, t, g, unknown or other
  modified_base (362)..(362): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctgagtgaagntctcctgcgaggcttctggttacacctttaacacctatggcatcctccgtgggtncgacacggcccctggacaaggacttggaggtggggtggggtggtcagcgtacttacgaagttgactacgactaaattngacacagaacgttcaggacagacgtcaccatacgaaccacgagacacatacccacgacgacacacgcctacagtaggaacgtaggacggacgaccgtaggagacgtaccgtacggaccgaacggaccggtaccgtattacgtttcgtacggtcggaccgaggtaacggtaaacggtaaaacggttcggtaacgggttaacgggttaacgggttacccggggggtaactaacggtaacgttacgggaaccgtaacccggggg

SEQ ID NO: 440850 - DNA, 690 bp, Homo sapiens
  misc_feature: GZ8MTXP02F7REA.10.88.H11.1.454.CMB.2.raw
  modified_base (282)..(282): a, c, t, g, unknown or other
  modified_base (287)..(287): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacaccttaacacctatggcatctccgtgggtncgacncggcccctggacaaggcttggaggtggggtggggtggtcaggcgtcttaccgaagttggactaacacgtaaacttgcgacaacgaaggtaacgttcccgagggtaccaaggtacgtacccaacctaagtacggaacccaaacgaacgaaccaacctaactacccgaacgacgaccaaacgacgaccctaacgacgttacgggaaacgtaggaacgggacgtaccgtagggaacgaacgttccgacggaccgaaccgacgggtaccgttattaacgtttccgtacggaccggtacggaaacggtaaacggtaaaaccggttaaaaggtacgggtaaccggttaaggggttaccgggtttacccggggggaactacgtaacggtacggaacccgtaacccggggg

SEQ ID NO: 440851 - DNA, 689 bp, Homo sapiens
  misc_feature: GZ8MTXP02IQKS4.10.88.H11.1.454.CMB.2.raw
  modified_base (282)..(282): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagccctggggcctcagtgaagatctcctgcgaggcttctggttacacctttaacacctatggcatctcctgggtncgacacggcccctggacaaggacttggaggtggggtggggtggtcaggcgtcttaaccgaaggtttcggacctaacaactaaaatttatagacaacgaggtaaacgtttcccgaggggtaccaaggtaacggtaccaaccgtaatacggaaacccaacaacgaaccaacaactacccaacgacgaccaacgaacgaccctaacagtacggaaaccgtaggaacgggacgacccgtaggaacgagtacgtacggaaccgaaccgaccggtacccggttaattacgtttaccgtacggtccggaccggaaaggaaacggtaaaaccggttaaaaacggtcggtaaaccggttaagggttaacgggttaccggggggaactaacggtacgttacggaacgtaacccgggg

SEQ ID NO: 440852 - DNA, 587 bp, Homo sapiens
  misc_feature: GZ8MTXP02GGUWT.10.88.H11.1.454.CMB.2.raw
  modified_base (282)..(282): a, c, t, g, unknown or other
  modified_base (362)..(362): a, c, t, g, unknown or other
  modified_base (440)..(440): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtctggggctgaggtgaagagcccgtggggcctcagtgaagatctctgcgaggcttctggttacacctttaacacctatgcatctccgtgggtncgacgacggcccctggacaaggacttggaggtggggtggggtggtcagcgtacttacgaagttggactacactaaattgngacaacgagtaaacgttccagggacaggacgtacaccatacgaccacagacacactaccacgacaccaacacgcctanagtaggaaactggaggacgacctagagatcgtagacgacgacggtaccgtattacgttcgtcgaccgacgtaaggaacggtaaacgtaaaaggtcgacggttaacgggtacggttaccgggggacacgtacgtacgacgtaaccggg

SEQ ID NO: 440853 - DNA, 519 bp, Homo sapiens
  misc_feature: GZ8MTXP02HB5ZS.10.88.H11.1.454.CMB.2.raw
  modified_base (351)..(351): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctgggggcctcagtgaagatctcctgcgaggcttctggttacacctttaaacacctatggcatctcctgggtgcgacaggcccctggacaaggcttgagtgggtgggtggtcagcgcttaccaagttggctacacaaattngcacagaagttccaggacagagtcacatgaccacagacacataccacgagcaacacgcctacataggaactagaggagccgtagagatctagacgacacgccgtatatttctgcgcgagacgacgtaaaagtgacgtggtagtaccgggggacacgatcgacgaccgg

SEQ ID NO: 440854 - DNA, 643 bp, Homo sapiens
  misc_feature: GZ8MTXP02JMM13.10.88.H11.1.454.CMB.2.raw
  modified_base (375)..(375): a, c, t, g, unknown or other
  modified_base (456)..(456): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcgagtgaagatctcctggcgaggtcttctggttacacctttaacacctatggcatctccgtgggtcgcgacgacggcccctaggacaaggtcttggaggtggggtggggtggtcaggcgtacttaccgaaggttcggactacgaactaaattntgacacagaacgttcagggacagacgtacacgatacgacccagacgaacacactaccaacgagaccaacgacgaccgtaanacgtaggaaactgggaaggacgcgtagagtacgtcgtacgacgtaccgacggtaccgtaacttcgtttacgacggtaccggaacggaaggaaacggtaaaacggttaaaaggtacggtaacggttaacggggttaacgggttaccccgggggaaataccgtaacggtacggtaaccgtacccggggg

SEQ ID NO: 440855 - DNA, 670 bp, Homo sapiens
  misc_feature: GZ8MTXP02G6L1W.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtgcccactcccaggttcagctggtgcagtcgtggggctggaggtgaaggcgcccgtgggggcctcgagtgaatatctcctgcgaggtcttcgtggttacacctttaacacctagtgctatctccgtgggtgcgacgacggccctggacaggtcgttggaggttggggtggggtggtcgaggccgtaccgttaaccgaaggttcggacctaacaactaaaacgttatcgacaacgagtaacgttccgagggacaaggtacgtaccacctagacgaacccagaacgaccaactacacccgaacgacgaccaacgacgaccctacgagtacggaacgtaggacggtacgccgtaggaacgtacgtcgtacggaaccgtaaccgaccggtaccgttattacgtttacggcggacggacggaaaggtaacggtaaaaccggtaaaaggtcggttaaacgggttgggttaacggttaccgggggtaacaaccgtacgtacggtacggtaacccgg

SEQ ID NO: 440856 - DNA, 593 bp, Homo sapiens
  misc_feature: GZ8MTXP02GEA8C.10.88.H11.1.454.CMB.2.raw
  modified_base (281)..(281): a, c, t, g, unknown or other
  modified_base (359)..(359): a, c, t, g, unknown or other
  modified_base (372)..(372): a, c, t, g, unknown or other
  modified_base (387)..(387): a, c, t, g, unknown or other
  modified_base (394)..(394): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcattgaagatctcctgcgaggcttctggttacacctttaacacctatgcatctccgtgggtncgacacggcccctaggacaaaggcttggaggtggggtggggtggtcaggcgtcttacgaagttggctacataaattangcacagaagttcnggacagacgtcacancgaccanagacacacaccacgagcacacgcctacataggaactaggaggtacgcctagacgtatcgtagacgacgaccggtacgtaattacgtttacgtcggtacgacggaaggaaacggtaaacggttaaaaaggtacggtaacggttaacggggttacggttaaccggggggactaacggtacgtacgaaccgtaaacccgggg

SEQ ID NO: 440857 - DNA, 583 bp, Homo sapiens
  misc_feature: GZ8MTXP02HGD3D.10.88.H11.1.454.CMB.2.raw
  modified_base (329)..(329): a, c, t, g, unknown or other
  modified_base (429)..(429): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgcccgtggggcctcgagtgaagatctcctggcgaggtcttctggttactacctttaacacctatggcatctccgtggtgcgacacggcccctggacaaggacgttgaggtggggtaggggnggtcgagcgtacttaccgtaggttcggactaacgaactaaattgagtacaacgagtaacgttccagggacaagagtccacagtacgaccacagacacacncacgagacacacgactacagtagactggagagctgagtatcgtacgacgacgacggtcgtaatagtttcgacggacgacggaacggaagtaaacgtaaaacgtcggtacggtaaggtacggttaccgggggacacgacgtacggacgtaccggg

SEQ ID NO: 440858 - DNA, 597 bp, Homo sapiens
  misc_feature: GZ8MTXP02G94CN.10.88.H11.1.454.CMB.2.raw
  modified_base (289)..(289): a, c, t, g, unknown or other
  modified_base (368)..(368): a, c, t, g, unknown or other
  modified_base (373)..(373): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtcgtggggctggaggtgaagcgcccgtggggcctcgagtgaagatctcctggcgaggtcttcgtggttaccacctttaacacctatggcatctcgtgggtcncgacacggccctaggacaaggtcttggaggttggggtggggtggtcaggcgtacttacgaggttcgactacataacttngacanagacgttcgaggacagacgtcacatacgaccacacgacacactaccagacgacacgacgacctacgagtacggaacgtaggacggacgccgtagacgtactacgtacggaaccgacgaccggtacttacgttacgtttcgacggtcgacggtaagaacggtaaacgtaaaggtggtacggtaagggtacggtaccggggactacgtacgtacggacgtaccggg

SEQ ID NO: 440859 - DNA, 643 bp, Homo sapiens
  misc_feature: GZ8MTXP02IOD4O.10.88.H11.1.454.CMB.2.raw
  modified_base (366)..(366): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggctttcgtggttacacctttaacacctatggcatctccgtgggtcgcgacacggcccctggacaaggtcttggaggtggggtggggtggtcaggcgtacttaccgaaggttggctaacactaaaattntacgacaacaggtaacgttccgagggacaaggacgtaccaaccatacgaacccaacaacgaaccaacactaccgaacgaacgaccaactacgacctacaacgtaggaaacctaggaaggacgaccgtaggaacgatacgtacggaacgacgaccggtacgtaacttacgtttacgtcggacggacgaacggaacggtaaacggtaaaacggtacggaacggttaacgggttaacggtaccgggggtaacaacgtacgtaacggaccgtaacccgggg

SEQ ID NO: 440860 - DNA, 585 bp, Homo sapiens
  misc_feature: GZ8MTXP02HLFWO.10.88.H11.1.454.CMB.2.raw
  modified_base (207)..(207): a, c, t, g, unknown or other
  modified_base (370)..(370): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngccctggggcctcgagtgaagatctcctgcgaggtcttctggttaccacctttaacacctatggcatctccgtgggtcgcgacacggcccctggaacaaggacttggaggtggggtggggtggtcagcgtacttaccgaagttcggactacactaaattacgngacaagagtaacgttccgagggacagacgtaccacatacgaccaacagacacactaccacgacgacacacgacctacacgtaggaacgtagaggacgccgtagaagtacgtcgagacgacgacggtacgtatacgtttcgcgtcgacgagacgtaaacgtaaagtgtacggtaaggtacggttaccgggggacacgtacgtacggacgtaccggg

SEQ ID NO: 440861 - DNA, 681 bp, Homo sapiens
  misc_feature: GZ8MTXP02G6AZ0.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtgcccactcccaggttcagctggtgcagtctggggctgaggtgaagagccctggggcctcagtgaagatctcctgcgagacttctggttacacctttaacacctatggcatctccgtgggtgcgacgacggcccctaggaacaaggcttggaggtggggtaggggtggtcagcgcttaaccgaaggttggactaacgaactaaaactttagtcgacaacgaaggtaaacgttccgagggaacaggtaacgtaccaaccgaatacgaacccaacaacgaaaccaacaactacccaacgaagacccaacgaacgaccctaaaccgataacgggtaaaccgtaggaaacgggtacgacccgtaggaagtacgttacgacggaaaccggaaccgaaccgggtacccgttaagttaactttcgtacggaccggacgaaggaaacggtaaacggtaaaaaggtcggaacggtaacgggttaacggttacccgggggaactaacgtacgtacggaaccgtaacccgggg

SEQ ID NO: 440862 - DNA, 569 bp, Homo sapiens
  misc_feature: GZ8MTXP02G0PTN.10.88.H11.1.454.CMB.2.raw
  modified_base (361)..(361): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggcttctggttaccacctttaacacctagtggctatctccgtgggtgcgacacggcccctggacaaggcttggaggtgggtggttggtcaggcgtcttacgaagttgactacgacaaattntgcacagaacgttccagggacagagtccaacctatcgaacccaacagaacacactccaacgagcacacgacctacatacggaacgagaggagccctaggagacttcgacggacgaaccgaccggaccgtaatactttcgacgcggacgaagagtaacgtaaaagtgacgtaaggtacggtacgggggacacgtagacgacgtaccggg

SEQ ID NO: 440863 - DNA, 639 bp, Homo sapiens
  misc_feature: GZ8MTXP02I5GLJ.10.88.H11.1.454.CMB.2.raw
  modified_base (282)..(282): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtncgacacggcccctggacaaggcttggaggttggggtggttgggtcaggcgtcttaccgaagttcggactacgaactaaattagtgacacgagtaacgttccgagggacaggagtaccaaccatcgaacccacagaacacactaccacgagacaacacgacctacagtacggaactaggaacgggacgaccgtaggaacgacgtcgtacggacgaaccgacggtaccgtagttaactttcgtcggtaccggccggaaggtaaacggtaaacggtaaaacggtacggtaacgggttaacggggttaacgggttacccggggggaacgtaacggtaacggtacggaaccgtaacccgggg

SEQ ID NO: 440864 - DNA, 693 bp, Homo sapiens
  misc_feature: GZ8MTXP02F9QZG.10.88.H11.1.454.CMB.2.raw
  modified_base (210)..(210): a, c, t, g, unknown or other
  modified_base (279)..(279): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggaatggacctggagcattcctttttcttggtggcagcagcaacaggtgcccactcccaggttcagctggtgcagtcgtggggctgaggtgaagngccgtgggcctgagtgaagatctctgcgaggtcttctgttactacttaacactatgcatctcgtgggtncgacgacggccccgtaggacaaggtcgttggaggtggggtggggtcggtcgaggtcgtacgttaccgtaaggttcggacctaacgaactaaacttagtacgacaacgaacggtaacgttacccgagggacaggtaacgtacccactatacggaacccaacgacgaaccacgactaccgaacgacgacaacacgacctaacacgtacggaacgtaggaacggacgtaccgtaggacgtacgtaccgtaacggaaccggaaacgtaccgggtaaccgtttatttacgtttccggacggaccggtacggaaaggtaaacggtaaacggttaaaacgggtggtaaaccggggttaagggttaaccgggggttacccgggggaactaacggacggttaccggaaccggtaacccggggg

SEQ ID NO: 440865 - DNA, 633 bp, Homo sapiens
  misc_feature: GZ8MTXP02IYSUV.10.88.H11.1.454.CMB.2.raw
  modified_base (207)..(207): a, c, t, g, unknown or other
  modified_base (355)..(355): a, c, t, g, unknown or other
  modified_base (363)..(363): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcgagtgaagatctcctgcgaggtcttctggttaccacctttaacacctatggacatctccgtgggtgccgacacggccccctaggacaaggacttggaggtggggtgggtggtcagcgtcttacgaagttgctanacaaattngcacagaacgttcaggcagagtccacatacgaccacgaagacacactaccgaacgacgacaacacgacctaacacgtacggaaaccgtaggaacggacgacccgttaggacgtaacgttcgtacggaaccgacgtaccgggtaccgtaactttaacgtttcgtacgtacggaccggaagtaacggtaaaccgtaaaaggttcggtaaccggtaaggggtttaccggtaccggggggtaaactaccgaagttacggaaccgtaacccgggg

SEQ ID NO: 440866 - DNA, 591 bp, Homo sapiens
  misc_feature: GZ8MTXP02ICDUL.10.88.H11.1.454.CMB.2.raw
  modified_base (358)..(358): a, c, t, g, unknown or other
  modified_base (408)..(408): a, c, t, g, unknown or other
  modified_base (457)..(457): a, c, t, g, unknown or other
  modified_base (481)..(481): a, c, t, g, unknown or other
  modified_base (488)..(488): a, c, t, g, unknown or other
  modified_base (492)..(492): a, c, t, g, unknown or other
  modified_base (499)..(499): a, c, t, g, unknown or other
  modified_base (532)..(532): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtgggggccctcgaggtagaagtactcctccgtggcgacggtctttcgttacggttaacctaaccttttaacaccttagtgacattctccgtggggtcacgacgacggcccctggaacaacggtcgttggaggtggggttggggngtacgaggcgtacttaaccgaggttcggaccttaacgaataaacgtttanacgacaacgtagtaacgtacgagaacagtactaccacagtacaccacanacacacacgacgacacacacacanagagagngagngcgaganacagacgacgacgacgtactattacgttcgcgngacgaagaacgtaacgtaacgtcgagtaacggtacggacgggacacgacgacgacgcgg

SEQ ID NO: 440867 - DNA, 719 bp, Homo sapiens
  misc_feature: GZ8MTXP02G4WRW.10.88.H11.1.454.CMB.2.raw
  modified_base (211)..(211): a, c, t, g, unknown or other
  modified_base (292)..(292): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagngcccgtgggcctgagtgaagatctccgtgcgaggtcttcgtggttactacctttaacacctatggctatcgtcgtgggtcncgacgacggccctaggaacaaggtacttggaggttgggggtggggtcggtcgaggtccgtaccgttaaccgtaaggttcggacctaaacgaactaaagttatcgacaacgaagtaaccgttccgaggggtaccaaggacgtaccaacctagtaccgaaaccaacgaacgaaccaacaactacccgaacgaacgaccaaaccgacgaccctaaacgacgtaacgggaaacgtaggaacggacgacccgtagggaactacgttaccgacggaaaccggaaccggtaccggtaccgttaagttacgtttacgtacggtaccggacggaaaggtaaacggtaaaacggttaaaacggtacggtaacggttaaggggttaaccgggttaccgggggaacaaccgtacggttaccggaaccgtaacccggggg

SEQ ID NO: 440868 - DNA, 637 bp, Homo sapiens
  misc_feature: GZ8MTXP02GQFNX.10.88.H11.1.454.CMB.2.raw
  modified_base (195)..(195): a, c, t, g, unknown or other
  modified_base (255)..(255): a, c, t, g, unknown or other
  modified_base (262)..(262): a, c, t, g, unknown or other
  modified_base (286)..(286): a, c, t, g, unknown or other
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttcnccgaggggacagagtccaccctctcctgtacgggccagttatggtgtggcgctattaacngtacaanagaacgtgccaggctccagctccncatctaacgagcatccaccagggccacgtggcgtccccagcccgtaggttccgatggcaggtcgggtcctggggacagaccttcgactctccaccaatcaacgtcaacgtcccgtagggacgacccgttagaaaaggtattaagttcgacgtaaggtttttaattaattgtaccaggtccaaggtccggttagaccgaggttcgggtcctttaccgacgtttaccggggcccgggtaaacctaaaagggtcgaaaatacccggaaaacgtacgtagggtcgactacgaccgtaaccctaagttcctaaggttcccttacgaacttccctttaccccggacctacgttaccc

SEQ ID NO: 440869 - DNA, 545 bp, Homo sapiens
  misc_feature: GZ8MTXP02JERTI.10.88.H11.1.454.CMB.2.raw
  modified_base (402)..(402): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttacacctttaacacctatggcatctcctgggtgcgacaggcccctggacaaggacttggagtggggtggggtggtcagcgcttaccgagttggactacactaaattatgcacagaagttccagggacagagtcaccatgaccacagacacanaccagacgcacacgacctacataggaactgaggagcctagagatcgtagacgacgacggaccgtatactttcgtgacgacggagacgaacgtaaaagtgtacggtggtacggttaccgggggacacgacgtacgacgtaccgg

SEQ ID NO: 440870 - DNA, 508 bp, Homo sapiens
  misc_feature: GZ8MTXP02JFD4L.10.88.H11.1.454.CMB.2.raw
  modified_base (351)..(351): a, c, t, g, unknown or other
  modified_base (475)..(475): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgaggtggggtggggtggtcagcgcttaccgagttgctacacaaattngcacagaacgttccaggacagagtcacatcgacacagacacactccacgagcacagcctacatagaactgaggagctgagagtcagacgacgacgcgtatattctgcgcgagacgacgtaaagngacgtggtacgtacggggacacgatcgacgacg

SEQ ID NO: 440871 - DNA, 702 bp, Homo sapiens
  misc_feature: GZ8MTXP02G46OM.10.88.H11.1.454.CMB.2.raw
  modified_base (285)..(285): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggcttctggttacacctttaacacctatggcatctccgtgggtncgacacggcccctaggacaaggcttggaggtggggtggggtggtcaggccgtacttaaccgaaggttcggactaacgaactaaaatttgagacaacgaaggtaacgttccgaggggacaaggacgtaccaaccagtacgaacccaacgaacgaaccaacactaccaacgacgaccaacacgacctacagtacggaactaggaaggacgaccgtaggacgtacgttacgtacggaacggaaccggaaccgggtaccgttaaacttaacgttttccggtacggtaccgggaccggaaaggtaaacgggtaaaaccggttaaaaacgggtacgggttaaaccgggttaagggggttaaccggggtttaacccggggggtaacaaaccggtaacggttacggaaaccggtaaccccggggg

SEQ ID NO: 440872 - DNA, 694 bp, Homo sapiens
  misc_feature: GZ8MTXP02HM5RQ.10.88.H11.1.454.CMB.2.raw
  modified_base (275)..(275): a, c, t, g, unknown or other
  modified_base (306)..(306): a, c, t, g, unknown or other
  modified_base (403)..(403): a, c, t, g, unknown or other
tcagcatagtagtgcacgaccggtgctcgatttagcgacagcgagaacacacaaaggggacccaaaaaccacaccctccttgggagaatccctagatcacagctcctcaccatggactggacctggagcattcctttttcttggtggcagcagcaacaggtcgcccactcccaggttcagctggtgcagtcgtgggctggaggtgaagacgccgtgggcctgagtgaagatcgtctggcgaggtctttcgtacggttacctaaccgttttaaacncctagtcggactacttccgtccggtgggtcncgaaccgccggccccgtaggaaccaaggtcgttggaggtggggtggggtcggtcgaggtcgtacttacgaaggttcggacctaacgactaaatttgngacaacgagtaacgttccgaggacaggtacgtaccaactagcaaccacacgacacactaccgacgacgaccaacgaacgaccttaacgacgtacggtaaacgtacggaaggacgaccgtaggaacgtacgtacgtacggaaccggaaccggaccgggtaacccgtttaagtttaacgtttccggttacggtcgggaacgaacggtaaacgtaaacgggtaaaagtacgggtaacggttaacgggttacgggttaaccgggggacaacggtacgtacggaccgtaaccgggg

SEQ ID NO: 440873 - DNA, 747 bp, Homo sapiens
  misc_feature: GZ8MTXP02HS8AE.10.88.H11.1.454.CMB.2.raw
  modified_base (236)..(236): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcaacaacaggtcgcccactcccaggttcagctggtgcagtcgtggggctggaggtgaagacgcccgtggggcctgagtagaagntctcctggcgaggtcttcgtaggttaccacctttaacacctagtcggctatccgtcgtgggtcgacgacgcggccccgtaggaaccgaaggtcgttgggagggttgggggtggggttggtcgacggtccgtacgttaaccgtaggttcggacctaacgaaactaaattacgacgaccaacgaaggttaacgttccggaaggaccgaaggtaacgtaccaaaccgtagtaccgaaacccaacgaacgaaaccaactaccaccgacggaacgacaaccgacgacctaacgagtacggaaacgtaggaacggacgtccgtaggaacgtacgtaccgtacggaaccggaaccggtaccgggtaccgtttaagttacgtttacgtacggacggacgggaaacggtaaacgggtaaaacggttaaagggtacgggttaacgggttacggggttaaaccggggttaccgggggaactacggtaacggtaccggaaccggtaccggggtaacccggggg

SEQ ID NO: 440874 - DNA, 549 bp, Homo sapiens
  misc_feature: GZ8MTXP02GQ8O7.10.88.H11.1.454.CMB.2.raw
  modified_base (355)..(355): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctccgtgggtgcgacacggcccctggacaggacttggaggtggggtggggtggtcaggcgcttaccaggttggctacacaattntgcacagagttccaggacagagtcaccatcgaccacagacacactaccacgacgcacacgacctacagtaggaactaggaggacgccgtagagactcgtacgacgacgacggaccgtatatttcgtgcgacgagaacgtacgtaaaagtgtacggtggttacggtacgggggacacgacgtacgacgtaccggg

SEQ ID NO: 440875 - DNA, 600 bp, Homo sapiens
  misc_feature: GZ8MTXP02JPSD3.10.88.H11.1.454.CMB.2.raw
  modified_base (280)..(280): a, c, t, g, unknown or other
  modified_base (351)..(351): a, c, t, g, unknown or other
tcagcatagtagtgcacgaccggtgctcgatttagcgacagcgagaacacacaaaggggacccaaaaaccacaccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtncgacaggcccctggacaaggacttggagtggggtggggtggtcaggcgcttaccagttgctacacaaattntgcacagaagttcaggacagagtcacatcgaccacagacacatccacgacgacacacgcctacataggaacgtaggagggacgccgtaggaacgacgtcgtacggacgaaccgaccgggtaccgtaacgttaactttccgtaggaccggtacggaacggaacggtaaacggtaaaacggtacggtaacggtaacgggtaacgggtttaccggggggaacgtaacgtacgtacggaaccgtaacccgggg

SEQ ID NO: 440876 - DNA, 607 bp, Homo sapiens
  misc_feature: GZ8MTXP02IV46M.10.88.H11.1.454.CMB.2.raw
  modified_base (207)..(207): a, c, t, g, unknown or other
  modified_base (283)..(283): a, c, t, g, unknown or other
  modified_base (288)..(288): a, c, t, g, unknown or other
  modified_base (365)..(365): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngcccgtggggcctcagtgaagatctcctgcgaggcttcgtggttacacctttaacacctatggcatctcctgggtncgacncggcccctggacaaggacttgaggtggggtggggtggtcaggcgtacttaccgaaggttggctaacgaacaaattangacacgaagtaacgttccagggacagacgtcacatagacccacagacacactccacgagacacacgccacataggaactggacggagcccgtgaacgacgttcgtacggacgaacgaccggtaccgttagttacgtttcgtggaccggacggtaacggaacggtaaacggtaaaaggtcggtaacgggttaacgggtacgggttaacccgggggaactacgacgttcgaaccgtaaccgggg

SEQ ID NO: 440877 - DNA, 663 bp, Homo sapiens
  misc_feature: GZ8MTXP02JMJ0B.10.88.H11.1.454.CMB.2.raw
  modified_base (271)..(271): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctggaggtgaagagcccgtggggcctcagtgaagatctcctgcgaggtcttctggttacacctttaacaccttanggctatctccgtgggtcgcgacgcggcccctaggacaaggtcttggaggtggggtgggtggtcaggtccgtacgttaaccgaggtttcggactaacgactaaaagtttcgtacgacgaacgaagttaaacggttacccgaaggggaacaaggtaacgtacccaaacccgtaagtaccgaaacccaaacacgaaaccacaactacccgaaacgacgacccaacgacgacctaacgacgtacgggaaacctagggaacggacgtccgtagagtactcgacggaccgacgacgtaccgttagtactttcgcggacgacgagaaacggtaacgtaaaaggtcgtaacggtaaggtacgggttaaccggggactacgacgtacggaccgtaaccggg

SEQ ID NO: 440878 - DNA, 595 bp, Homo sapiens
  misc_feature: GZ8MTXP02JJVLM.10.88.H11.1.454.CMB.2.raw
  modified_base (207)..(207): a, c, t, g, unknown or other
  modified_base (359)..(359): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatcctttcttggtggcagcagcaacaggtgcccactcccaggttcagctggtgcagtctggggctggaggtgaagngccctggggcctcgagtgaagatctcctgcgaggtcttcgtggttaccacctttaacacctatggcatctcctgggtgcgacacggccctggacaaggcttgaggtggggtggggtggtcagcgtcttaccgaagttggctacactaaattngcacagtaacgttccaggtacagagtaccaccagtcgaaccacagacacactccaacgacgacactacgacctacacgtaggaactaggaggacgcccgtagagtatcgtacggacgacgaaccggtaccgtattaacgtttacgtcgcggtaccggaggaaacggtaaaccggtaaaagtcggtaacggtgggtaacggttaccgggggaactacgacgtacgacgtaacccggg

SEQ ID NO: 440879 - DNA, 685 bp, Homo sapiens
  misc_feature: GZ8MTXP02HN7VM.10.88.H11.1.454.CMB.2.raw
  modified_base (306)..(306): a, c, t, g, unknown or other
  modified_base (460)..(460): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtgggctggaggtgaagagcccgtggggcctgaggtgaagctctcctggcgtaggtctttcgtggttaacctaacctttaacaccttagtcggactacttcctccgtggggtcnccgacgaccggccccgtaggaaccaaggtacgtttggagggtcggggtggggtcggtcgaggccgtactttaaccgaaggttcggactaaacgaactaaagttagtcgacaacgaagtaacgttacccgagggacaaggtacgtaccaaaccgngtaacgaacccgaacacgaaacactaacacccgaacgacgaaccaacgaaacgtacctaacgacgtaaacggtaacgtacggaaggaacgtaccgtaggaacgtacgtaccgacgaacgacgaccggtacgtaattacttcgtagccgacgaaaggaacgtaaacgtaaagtcggaggtaacgggtacggtacgggggacaacgtacgacggtaacgacccgggg

SEQ ID NO: 440880 - DNA, 655 bp, Homo sapiens
  misc_feature: GZ8MTXP02GLWQA.10.88.H11.1.454.CMB.2.raw
  modified_base (284)..(284): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggtcttctggttaccacctttaacacctatggcatctcgtgggtncgacacggcccctggacaaggcttggaggtggggtggggtggtcaggcgtcgttaaccgaaggtttcggactaacaacgtaaatttagtcgactaacgaggtaaacggtttcccaggggtaccaaggtacgtaccaacctagtacggaaacccaacgacgaaccacactacccaacgacgaccaacgacgacctaacacgtacggaaacgtggaaggacgccgtaggagactcgtacggacgaaccgtaccggtaccgttagttacgtttcgtacggacggtacgaaggaacggtaaacgtaaaacggtacggtaacgggtaagggttacgggttaccgggggactacgtacgtacggaacgtacccgggg

SEQ ID NO: 440881 - DNA, 659 bp, Homo sapiens
  misc_feature: GZ8MTXP02FULKV.10.88.H11.1.454.CMB.2.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcgagtgaagatctcctgcgaggtcttcgtggttaacctacctttaacacctatcggctatctccgtgggtcgcgacacggcccctggacaaggcttggaggtggggtggggtggtcaggcgacttaccgaaggttcggactaacgaactaaattgtcgacaacgtaaggtaaacgttcccgaggggtaaccaaggtaacgtaccaaccgtaagtacgaaacccaacgaacgaaccaacaactacccgaacgacgaccaacacgaccctaacgacgtacggaaacgaggaacgggtacgacccgtaggacgtacttcgacggaccgaaccgaccggtaccgttaattacgtttcgcggacgacggaaaggaacggtaaacggtaaaagtggtacggtaaggtacgggttacgggggaacacgacgtacggacgtaccggg

SEQ ID NO: 440882 - DNA, 610 bp, Homo sapiens
  misc_feature: GZ8MTXP02HOFK1.10.88.H11.1.454.CMB.2.raw
  modified_base (371)..(371): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcattcctttttcttggtggcagcagcaacaggtgcccactcccaggttcagctggtgcagtcgtggggctggaggtgaagacgccgtggggcctgagtgaagctctctgcgaggtcttcgtgttacacctttaacacctatggcatctccgtgggtcgcgacgaccggtcccctaggaacaaggtcttggaggtcggggtggggtggtcgagcgtacttacgagttgactacactaattangcatagtacgttcaggacagactcacagtcaccacagacacactacacgacacacacgcctagagtaggactaggacggacgcctaaggatacgtacgtacggaccgaaccgtacggtaccgttaaattcgtttacgcggacggacggaagtaaacggtaaacgtaaaggtagggtacggtaaggggttaccggggtaccgggggacaacggttacgtaacgggtaccgtaaccggggg

SEQ ID NO: 440883 - DNA, 609 bp, Homo sapiens
  misc_feature: GZ8MTXP02JQV58.10.88.H11.1.454.CMB.2.raw
  modified_base (284)..(284): a, c, t, g, unknown or other
  modified_base (361)..(361): a, c, t, g, unknown or other
  modified_base (396)..(396): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagacgccctggggcctcagtgaagatctcctgcgaggtcttctggttacacctttaacacctatggcatctccgtgggtncgacgacggcccctggacaaggcttggaggtggggtggggtggtcaggcgtcttaccgagttgctaacactaaattngacacgagtaacgttccaggacaggacgtcaaccntacgaaccaacagaaccacactacccaacgagaccaacacgacctacagtacggaacgtaggaggacgccgtagagtactcgacggaccgaaccgaccgggtaccttaacttactttacgcgtacggacggtaacggaaacggtaaacggtaaaaggtgtaacgggttaagggtacggttaccgggggactacgacgtacgaacgtaaccggg

SEQ ID NO: 440884 - DNA, 699 bp, Homo sapiens
  misc_feature: GZ8MTXP02JL8WM.10.88.H11.1.454.CMB.2.raw
  modified_base (207)..(207): a, c, t, g, unknown or other
  modified_base (282)..(282): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagngccctggggcctcagtgaagatctcctgcgaggcttctggttacacctttaacacctatggcatctccgtgggtncgacacggcccctggacaaggacttggaggtggggtggggtggtcaggcgtcttaccgaaggttcggactacgactaaacttgtcgacaacgtaggtaacgttcccgagggtaaccaggacgtccaaccagtcgaaccacagaaccaacacaccaacgagaccaacacgacctacgacgtacggaaaccgtaggaacggacgaccgtacggtagacgtacgtacggaaacccggtaaccgaacccggggtacccgtttaaacgttaacgttttaccggtcggtaacccggtaacgggaaaccgggtaaacggtaaaaccggggttaaaaacggtacgggtaacgggttaacggggttaacggggttaacccggggggtaacaaacggtacggttaccggaaccggtaaccccggggg

SEQ ID NO: 440885 - DNA, 541 bp, Homo sapiens
  misc_feature: GZ8MTXP02INQ7M.10.88.H11.1.454.CMB.2.raw
  modified_base (281)..(281): a, c, t, g, unknown or other
  modified_base (286)..(286): a, c, t, g, unknown or other
  modified_base (328)..(328): a, c, t, g, unknown or other
  modified_base (346)..(346): a, c, t, g, unknown or other
  modified_base (353)..(353): a, c, t, g, unknown or other
  modified_base (447)..(447): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctcagtgaagatctcctgcgaggcttctggttacacctttaacacctatggcatctctgggtncgacnggcccctggacaaggcttggagtggggtggggtggtcagcgnttaccaagttggctacanaaatttngcacagaagttccagggacagagtcacatgaccacagacacatccacgagcacacgacctacataggaactaggaggacgcctagacgactcgngacgacgacggaccgtatactttcgtgcgacgagacgaacgtaaaagtgtaacggtaaggtacggttacgggggacacgagtcgacgtaccggg

SEQ ID NO: 440886 - DNA, 627 bp, Homo sapiens
  misc_feature: GZ8MTXP02HK4PB.10.88.H11.1.454.CMB.2.raw
  modified_base (334)..(334): a, c, t, g, unknown or other
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtgggggcctcgagtgaagatctcctgcgaggtcttcgtggttacacctttaacacctatcggcatctcgtgggtgcgacgacggcccctggaacaggcgttggaggtggggtggggtcggtnacggcgtacttaccgaaggttggacctacgaataaaacgttatcgactaacgagtaaccgttccgaggggactaggacgtaccacctagtacgaccaactacgacaacgacacccagacgaccactacgacctacacgtaggaaccgtaggacggagtccgtagggaacgtactcgtacggaacgacgtacgggtaccgtattacgtttcgacggcgacgaaggacgtaaacggtaaagtcggtaacggtgggttacggtacccgggggaaacacgtacgtacggacgacggg
